United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 31

SEQ ID NO: 34937 - DNA, 4215 bp, Homo sapiens
gctttcatcgcctttactccccgaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacaca

SEQ ID NO: 34938 - DNA, 2071 bp, Homo sapiens
gctttcatcgcctttactccccgaccttccttcgagtctgtttatccgttgcagcctcccttccccacgacggggcgcctctgcaactcacagttgaagagtctataaaccaacccccctcgccccgtgccacaactccaaaaactgaaaagataagcactgccttgatgatccgtatggggaactaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactgg

SEQ ID NO: 34939 - DNA, 1046 bp, Homo sapiens
gcgagggaaccttttatgaagctttcttcatagataatcgtgttgtggttgaagagtctataaaccaacccccctcgccccgtgccacaactccaaaaactgaaaagataagcactgccttgatgatccgtatggggaactaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtaagtagaaggaggtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaaca

SEQ ID NO: 34940 - DNA, 1621 bp, Homo sapiens
ggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactg

SEQ ID NO: 34941 - DNA, 579 bp, Homo sapiens
atacaaattccaggctaacggtgacagtggctgcctcggggagtgggactaaggaggggtaggtggggtttgacattttactttattaattttggtattgtctgagggtttttaaaccataaataatgtattaattttaaaaatgcttttaaaaatcatcattttcaatagttaacggtctatgcttcatcaacgttttccgtttaaaacctgtgtgcggcccacacacgtatgacattctgattatgtgattcactgctgaaaaagaactggacgccaggaaattgggggttgagtccgaagcaaggtgaacgccggacatcgagacatggaatcctagaccggcccggaagtgcctctgctccgtccgccttcgaggagaggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaa

SEQ ID NO: 34942 - DNA, 1601 bp, Homo sapiens
ggccattgttcgtgccgcgcttctagcaacgccgggccggcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactgccacagccaacatgcc

SEQ ID NO: 34943 - DNA, 1791 bp, Homo sapiens
atctttgttccctgcccggccattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatttaatacgaagtttgaggagaagggcagtactgatcccacttggggcccatctgttctctacagacacatttttattttccaaacctgttgtgatcccccagctaaaaggaggaggagaaacatggcctaacaacagaggagtcctaagagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactg

SEQ ID NO: 34944 - DNA, 2021 bp, Homo sapiens
gctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatg

SEQ ID NO: 34945 - DNA, 2023 bp, Homo sapiens
atggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaat

SEQ ID NO: 34946 - DNA, 2970 bp, Homo sapiens
cttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatgggaaaaataagcaaggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagaggctctttgtggttgttttatatacttgtaagtgatttatgagataggtgtttagaataatactcttctgttagggtcaccctgatcagaccgttcccttcccctcccacaggacttacaatacggtcccttgtgctctctgcacagctaccccagggcaaaaaacaaaccccccttcactgatccctccagtaactgtgcagacagttacaggatgcggttaacatgtctgttcacctcgcataacaaagctggcaaaaaacatctccaggatgcagacaagacacctgcaccctcgactaagctcccccaccccaacccagttctcctgcacccccaactcagctcccgcaccccgacctagttctggccctataaaaacctgctatagtctgtaagcagggctgcctcctctaactgtggtggagcagccaagcagctcaataaagcttgcttgcctga

SEQ ID NO: 34947 - DNA, 2369 bp, Homo sapiens
cctttgtcccgacagagctccacttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgcactgtgctcacctggggtgctgcaaactgtgaaatggtttttagagttcagatgcatcttctcactagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatgggaaaaataagcaa

SEQ ID NO: 34948 - DNA, 2389 bp, Homo sapiens
aatcaggcacatgtctggagaggagaggacggcttccgggatctagcggggcctttgtcccgacagagctccacttcctgtccccgcggctctgtgtcccctgctagccgtaggtcgtgtgacccgcaggcaccgggagatccagaagtgaaacgccaggctctctggaggccaggagatggcacagacaccttaccagaatgtctttggtttgaggttccactttggaaacttgacagggtgatttgctctcagccaccctctggactttttcctcagtttcagtattgtccagggataacacaggatgcccaccatggccatgtctgctggagcatctagtgaatttcaggccctgggttatttctcagaggacagcctgaggtatgaagtgtggcctctccagggagcagctggatgccctgggctgagagaaatctcctggtctactcttcctctaaagaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgt

SEQ ID NO: 34949 - DNA, 2008 bp, Homo sapiens
acttcctgtccccgcggctctgtgtcccctgctagccgtaggtcgtgtgacccgcaggcaccgggagatccagaagtgaaacgccaggctctctggaggccaggagatggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgag

SEQ ID NO: 34950 - DNA, 579 bp, Homo sapiens
gtccccgcggctctgtgtcccctgctagccgtaggtcgtgtgacccgcaggcaccgggagatccagaagtgaaacgccaggctctctggaggccaggagatggcatattctcacgatgcaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaa

SEQ ID NO: 34951 - DNA, 682 bp, Homo sapiens
gtcccctgctagccgtaggtcgtgtgacccgcaggcaccgggagatccagaagtgaaacgccaggctctctggaggccaggagatgtttcagtattgtccagggataacacaggatgcccaccatggccatgtctgctggagcatctagtgaatttcaggccctgggttatttctcagaggacagcctgaggtatgaagtgtggcctctccagggagcagctggatgccctgggctgagagaaatctcctggtctactcttcctctaaagaggtgtgatttgtccagagaatctttcctaagaggaaatcccagagaagcaggagaaagagaaagaaatggctggtgctcagactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgt

SEQ ID NO: 34952 - DNA, 2604 bp, Homo sapiens
aacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcgatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtg

SEQ ID NO: 34953 - DNA, 3888 bp, Homo sapiens
tctcccaacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcgatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtgaatgacttttctacttaccaaattctctccattcagaacacctcttggatttgcatactttctctgaattcacagcccagcctatacttttatcatccccagctcccactcctggcagcagtagctttctaattccagttcttcctgctttattgaagagggatgtgctaagctgtggtacagtaacaagcccgcagagagctatgtctcccttaaaacctgacgggaaccattctgtcttattctatcctcattatttggaacatctggcttccaaagtcaccacaagggcggaagagaaagctagaggaatttgtaggatattttcttagacccaggcttacatcacttctgtccacatctaataagccagaacccagcacctagaagctaggaaagtaaacaagcacctcgaaagttggttaataccaagaacctctctcacagttatattttgcatactactgttaagccagtctttgcaaatgaccccttcctgcccatcactgccttcctcaagacctaaaatagctccctatttagtgaaaaattatctgaatatttaaggtctgccttaacgtgatccccattgctgaattttacctcctgactccaaaaactcttctcttccctgggcccagtcctatttttttttttttttttttttttgtgagacagagtctcactctgtcacccaggttggaatgcaatggcacaatctccgctcactgcaagctccgcctcccgggttcacgccattctcctgcctcagcctcccgaatagctgggactacaggtgcccgccaacacgcccggctaattttttgtatttttagtagagacggggtttcaccgtgttagccaggatggtctcaatctcctgacctcgtgatccgcccgcctcggcctcccaaagtgctgggattacagacgtaagtcaccgtgcccggcctatatttttattttattaaaggttaggcactagatgaccttgactctaggcatctgcattctcttgatctttgcttagggtgaagctcagaaaaggacttggttctgaaaggctgtctggaattagattgtcctacgtgattcccagtgaattgagatgaatttcctctggaagttcaagtcggattcgagaagctgaattaccaaacagaccctccccaacctactaacgaccctattactctgttcaccctagagcagacgaacggcagggaagacttgatctgtggacttttgaaagcaacttgaggaaaaacacataacagaatctataggtgtggacaatatgtgatattgctaaataatgtcaagtaggaaataaaagagactattgacaaa

SEQ ID NO: 34954 - DNA, 3740 bp, Homo sapiens
tcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggaatcagtgacattcgaagacgttgccgtggttttcacagatgaagagtggagtcgtctggtccccatacagagggacctctacaaggaggtgatgctggagaactataacagcattgtgtcattggactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttatagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcgatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtgaatgacttttctacttaccaaattctctccattcagaacacctcttggatttgcatactttctctgaattcacagcccagcctatacttttatcatccccagctcccactcctggcagcagtagctttctaattccagttcttcctgctttattgaagagggatgtgctaagctgtggtacagtaacaagcccgcagagagctatgtctcccttaaaacctgacgggaaccattctgtcttattctatcctcattatttggaacatctggcttccaaagtcaccacaagggcggaagagaaagctagaggaatttgtaggatattttcttagacccaggcttacatcacttctgtccacatctaataagccagaacccagcacctagaagctaggaaagtaaacaagcacctcgaaagttggttaataccaagaacctctctcacagttatattttgcatactactgttaagccagtctttgcaaatgaccccttcctgcccatcactgccttcctcaagacctaaaatagctccctatttagtgaaaaattatctgaatatttaaggtctgccttaacgtgatccccattgctgaattttacctcctgactccaaaaactcttctcttccctgggcccagtcctatttttttttttttttttttttttgtgagacagagtctcactctgtcacccaggttggaatgcaatggcacaatctccgctcactgcaagctccgcctcccgggttcacgccattctcctgcctcagcctcccgaatagctgggactacaggtgcccgccaacacgcccggctaattttttgtatttttagtagagacggggtttcaccgtgttagccaggatggtctcaatctcctgacctcgtgatccgcccgcctcggcctcccaaagtgctgggattacagacgtaagtcaccgtgcccggcctatatttttattttattaaaggttaggcactagatgaccttgactctaggcatctgcattctcttgatctttgcttagggtgaagctcagaaaaggacttggttctgaaaggctgtctggaattagattgtcctacgtgattcccagtgaattgagatgaatttcctctggaagttcaagtcggattcgagaagctgaattaccaaacagaccctccccaacctactaacgaccctattactctgttcaccctagagcagacgaacggcagggaagacttgatctgtggacttttgaaagcaacttgaggaaaaacacataacagaatctataggtgtggacaatatgtgatattgctaaataatgtcaagtaggaaataaaagagactattgacaaa

SEQ ID NO: 34955 - DNA, 1468 bp, Homo sapiens
gaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagcccaggaaaaaaactgcatctgttttctgtttgttccagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtctt

SEQ ID NO: 34956 - DNA, 2316 bp, Homo sapiens
ctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaatactcactgatgcccaactcttctatagattgagttggtttaagaggtctactttgtattgcaagcattgttgtttctacggattagcgagcctgttcttgattaaaccaactagatgggagcttg

SEQ ID NO: 34957 - DNA, 3061 bp, Homo sapiens
agaagcgccggggcggagcccggccaacggtccgtccggaaggaggaggcccattccagcttctacttttgttgctatgcaggttgttgtcgggataccagatttcctactccgagaggccccgggtccctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagatacatgcccactttgctgtttcttcagaaatgttaaaatgtttaccagagaactaataaatgttgttatggctggaaatactcactgatgcccaactcttctatagattgagttggtttaagaggtctactttgtattgcaagcattgttgtttctacggattagcgagcctgttcttgattaaaccaactagatgggagcttgttcctctgctgcattgtgcagtgattggtctcaccaagggcttttatgtgagaagagccaccttgctcttatcaggaaatttcaagcatttgctgttattcacaactgaatgtaatgtctcacttcgtttttaactttgtatgagtatacctgactaaaaacactaatgcggtttcttggcaacaaatacttctgttcatgtattttagaaataagcttattaactgtttataacaactgcatactaacaattattattttttaatgaagaagctacattacaacctcccattaacatcatgtattagatcaagttgataatgttaccatgttatccggtggtcactgtgagtcagtgttgccatgtggatgtcaggcatatttttcctcatgtagattttacttttcatgcttatattcttagtttttatctggatcatgaattttcatctattctaaataccaaaggtgatctcatgttcttatgagtgacttctgaccaaagaccaccagtggcataagtgtcgtcaaagagggtgtaataatatactgtggtaatgaatatgaccaaaagccatagatgactgtgagatgtgtgagatattaaaagatagtcacatttcgtgagaagagaaaaa

SEQ ID NO: 34958 - DNA, 3082 bp, Homo sapiens
gcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 34959 - DNA, 3025 bp, Homo sapiens
ggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 34960 - DNA, 3133 bp, Homo sapiens
gccagcccgtcgtggatgactagagccaaccacctgccttccgtcttccaggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 34961 - DNA, 3303 bp, Homo sapiens
tttcccagcaggccctggggttagactggccgcagctggagaggtgccagcccgtcgtggatgactagagccaaccacctgccttccgtcttccaggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 34962 - DNA, 3387 bp, Homo sapiens
acttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgagggcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 34963 - DNA, 4130 bp, Homo sapiens
aaggccccacgtgttccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaaggttgtgggatagccttgggaggagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttcagtgtcctgatacttctgagggtggttcatactcaaatagatctgggagtacagagtatttttccttgaggaaaggaagggttgggatgattagcagagtccggtgaaacat

SEQ ID NO: 34964 - DNA, 3384 bp, Homo sapiens
aaaggccccacgtgttccgacccgctaggccccgcgcggctcggatccggcggcgctgtttcggtcgggagtgggtgggagagaagccggggcaggggaggagccgccggagctgtcggagccggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgta

SEQ ID NO: 34965 - DNA, 3564 bp, Homo sapiens
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgta

SEQ ID NO: 34966 - DNA, 1947 bp, Homo sapiens
actcccagtctccacccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgcggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggc

SEQ ID NO: 34967 - DNA, 2062 bp, Homo sapiens
tcctgtcttccctactcccagtctccacccaactcccccgcccgccccgtgcaggctgtggagactcccttcccgggggagggggcccccactgccgcaggtgccccctctgcctccaccccggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgcggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaa

SEQ ID NO: 34968 - DNA, 1006 bp, Homo sapiens
ggggccaggaccgggtttgggaaggagaaggacattgtctgccaggaccgagagcaggatgggcatcccaggcctggggcaggtggttgcagctgcaggggggctgctgagagcgggcaggttgatttctgaattcctggtgggcatgggagtcagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtccc

SEQ ID NO: 34969 - DNA, 659 bp, Homo sapiens
gcagatgatcagcttgcaggaggggatggggtcaaaggtggaaggcttcaagctggcaggagagaagggggccaggaccgggtttgggaaggagaaggacattgtctgccaggaccgagagcaggatgggcatcccaggcctggggcaggtggttgcagctgcaggggggctgctgagagcgggcaggttgatttctgaattcctggtgggcatgggagtcaggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcc

SEQ ID NO: 34970 - DNA, 2229 bp, Homo sapiens
cggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgc

SEQ ID NO: 34971 - DNA, 2025 bp, Homo sapiens
cggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgc

SEQ ID NO: 34972 - DNA, 1713 bp, Homo sapiens
cgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaa

SEQ ID NO: 34973 - DNA, 13767 bp, Homo sapiens
cgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttttgggatctgtttttctgatcttttgcagggtagttttatgattttttaggcatcaaataacctatgcaaagtattaatataatgaactcaagttgagtttttctcattataaagttaagacttctaagaaaatggtaacatttctttataactttcctgtgaaggtatagataaaacacatgaagtctgaagttgtatggaaaaaagggctttaactttgaaggaaaatatattgaaaagtgatttagccatcacaaaagagttcgtatttatgtgacagatgaaagtcatacctttaagcaaaacattgcaagtattataaagctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgattatctggcttcaatgattttggctcctgtgcttgtggtaccatagtggtacaaaaattttcatagtttgaaaataaaacaggtattttgccagtaatgtatttctttctgccagcagccaagtcccaaaccactttcccctctgaacctctgcttacctaaatggtttcaaaattaatacatgctgctttgatttggcagcacacttaatatactgctgaaggaaaacttgtgttgaaagtctttaagataaaaatggtgtgataggccgggcgcagtggctcacgcctgtaatcccagcactttgggaggcccaggcgggtggatcatgaggtcaggagatggagaccatcctggctaacacggtgaaaccccgtttctactaaaaatacaaaaaattagctgggcgtagttgcggatgcctgtagtcccaactactctggagaccgaggcaggagaatggcgtgaacccgggaggcatagcttgcagtgagcggagatcacaccactgcactctagcctggacgacagattgagactccgtctcaaaaaaaaaaaatgctgtgattaaatttagaataattaagtaaggggtgctctcccaaattctcaggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgaggcaagtgggatttattttattccttataggggctttcacagctttatggctgttggatatttatgtccccaaacttgcagcaagtttggtgaaggcccctaaatttaattaaacttaggatttttatactcttttggcagagaaggctctatattaatattcacgtttgactgtggtgttaataaacataagtatttcatatgcaattttatgtaatttgctgtgtgttacataattaacagcttcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactggatactgaaatgtgccttctcttttttgagacggagtttcactcttatcacccaggatggagtgcagtggtgcgatctcggttcactgcaacctctgcctcccggattcaagtgattctcctgcctcagcctcccgagtagctgggattataggctcccgccaccacatctggctattttttcaatatttttcagtagggatggggttttgccgtgttggccaggctggtctcaaactcctgacctcaggtgatccacccatctcagcctcccagagtgctggagtagcaggtgtgagccaccgcgcctggccaaaatctgcattctttttttttttttttttttttttttgagactgtctcgctgtgtcacccaggccagagtgcagtagcacgatctcagctcactacaacctccacctcctggattcaagcgattctcctgtctcagcctcccgagtagctgggactacaggtgcttgccaccacacccggctaattttttgtatttttagtagagacggggtttcaccgtgttagccaggatggtctcgatctcctgactttgcgatccccctgcctcggcctcccaaagtgctgggattacaggcgtgggccaccgcgcttggccaaaatctgcattcttaatcacaaacttacgcattgaatgttaaggctaaaaggtcatctggaaatgcttaattttaaaatattttcaagcctcaccacattagagcaaatgttaatgtagagccctgtaaaggtgggaaggtggtgtctatgtgtgtgcttgtgtatgtgggggtatagaccatatagttgatataacaacagaatttgggtgttacagacctttcagcatggatggattactaattttcaggtatcgaaactgaaatttgatacctgatcctgtggtaaagtatgttaaactatggttttggagtgattattttgaggttcattttcagcctcactgaacagtgttttacgcacatgtgaaaagtatccacatttgtttccaactaaaatttgcttttatttggtgagaaaagttgtgtgcgtgtgtttgttgtagggaataattagggaattggaagagaggccaaaaacaaacctgaattacttttgtttcttgtgtttgagccacgattctatccagatagcagtttactctgagcagtaacaatgaacaagcagtatagcatttagcaaacctggaattgtttgtatatggttttcattcttggaagcataaagaaaaaatatgcattaaatgaattgtaaattttgacttgttaaataacatgtttttcactataactaataggattttaatatttaaagaattttgttgcttccatgacaaaatatcccattggactattttataacctcagtaatcaacatttaagagtccttaattggagatctgttttctctattacctaccatcctgcaatatgctgaaatctttctaagttgcttatcttaattctaatggtgataattgaaaaaagtgtgctggaaatacaggctcttatctggttgagtactgggggtgggaaggatttagtaatgtcataatctgttgaaggtaatatctatagataactaagatagttcctttttttttgtagttctgtgactcagacaaataagattttgagaattatgtagtttttaggtgtctgtaacatccactagtaaaacttggcaaatgaaagaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataatggatattcattaattttgtgattagtgctgagttttctaaactactatcttaagctcttaggcaccctattatggatctaattcaaaccaatatgtaggaaatggagaaagtaggacttcagtttgcgcttcccaataactttaaatatatccaccttttccaagtgtttaagccctaaaacatctatctttatttttttacctggcatttttgttagaaaatagattacgttttaaagtaacattaaaaaaattcttcagtaagataattgcttttaataagtatatttttcttgctcttggctctatacatttttgcataatattttagtcttgaaaagcttttcattttcttaactctggaaaataatagtttggaactaaattagtttgagaaatctgaatcatctctctttaaatctgttcagttagtctcatgtattctcaggggaaaatgtctttattttactaagcggaagtagtagtcatattgaggcagaaatttgtagcccaaacaaggtaggtcttcgctgaaactaatttgaactattcctatttgaagcaaattgaacactattataaatctagactggctaattagatggaaactttgatggttaggttctttaagaggcatacaatccgttatgagaatgtttatgtttatgttttaatttttatcaaaataacctcagaggaggtacatgtgagtaaactgtcttaatggttgattacttggaacccacccattaattctaaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttcaccattggttaagtctgaggaactaacagtgaaattcattgatggccaacttggataaaaatgaagaatgatattttcccagtttactacacatggaccaatagtgattatttgggagagaacactgggtagtattgtttgacttaagaaccttaaatatattgaaaagtaatggcattcttgctcatgatttgcatttgttagtgaggtctcaccatagtattttaatgtagcttcttattaaaattttattcataaatagtttagcagtcacagaggtgaaaaaaaaaagatttgcaccatcatatccgagtctttactaataaaatgaggctgcttaagtacccaagtggagcaagggaagagttactacagttactgtaagtctgagttagaaaaaatacagagcatctagttattgagcaaagcccccttttacctgttcgcttattcaaagagaaacaatagaatttgcttctcagtacatgtttttaaaattgagaatctctgatgtgacaaaatcaatttttacaaaagttgaattaaaaacttttaaaaattgcttgtctttgggggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaactagggaaaagttttaaatgtattagtatcaggctctgaggaaatttaatgcacattgactttttaaactatggattgaactcctcagtttaatacaatttgtgtttttgttaactagcagcagaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttat

SEQ ID NO: 34974 - DNA, 2083 bp, Homo sapiens
cgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatt

SEQ ID NO: 34975 - DNA, 1627 bp, Homo sapiens
cggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggacttccc

SEQ ID NO: 34976 - DNA, 9088 bp, Homo sapiens
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttagtatgttctcaatccttactaaacataaggtaattcataatggagagaaaccctacaaatgtgaagaatgtgataaggcaactcatgctggagagaaaccctacaaatgtgaagaatgtggcaaagctttcaactggtcctcaaaccttatggaacataagagaattcatactggagagaaaccctacaaatgtgaagaatgtggcaaaagcttcagtacattctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataagtcatcctcaacccttagttatcataagaaaattcatactgaagagaaaccttacaaatatgaagaatgtggcaaaggctttagtacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagagaaactctagaaatgtgaagaatgtggcaaagcctataagtggccctcaacccttagttatcataagaaaattcatactggagagaaaccctacaaatgtgaagaatgtggtgaggctttcaactggtcctcaaaccttatggaacataagagaattcatactggagagacaccctacaaatgtgaagaatgtggtaaaggctttagtatgttctcaatccttactaaacataaggtaattcatactggagagaaaccatacaaatgcaaagaatgtggcaaagcctataagtggtcctcaaccctcagttatcatagaaaattcatactggagagaaaccctacaaatgtgaagaaagtggcaaagccttcagctggttctcagtctttagtaaacataagaaaattcatgctggagagaaattctaaaaatgtgaagaatttggcaaagcttttaaacagttcccaaccctcctacacataagaaaattcatgctggagagaaactctacaaatgagaagaatgtggcaaaggcttcaaccagtcctcaaaccttatggaacataagagaattcatactggtgagaagccctacaaatgtgaagaatgtgataaagacttcaactggtcctcacaccttactactcataaaagaattcatactggaggaaaaaccctacaaatatgaaaaatgtggcaaaactattaattaattctcaacgcttactgaacataagggaatttgtacaggagggaaaccctacaaatctgaagaatgtggcaagccttttagctattcctcaatccttactaaacattcatgtaattcatactggagggaattcctacaattgtgtggaatgttgcaatgcccttaaccagtccttaaggcttactacatataagacaactcatactggagagaaaccatgcatgtgtgaagaatgtgggaaagcctctaatagatcctcaattcttaagagacataagctaattcatacacaagagagactctacaaacctgaaagatgtgacaatgcttttggcaacacctcagacttttctgaatataaaagaaatcgtacagatgagaaatcctagaaaagtgaagaatatgacaaagcctttaagtggctgtcacacttgattgtaggtaagataactcatactggagaaaactactgtaataaacaatgtgacaaacatttaaccagtgctcatgccttattgcaaaggaaagcatttacactagcctgggcaacagagagagactgtctggaaaaaaaaatttttgttaatgccagtaatatcttctcacagcttattaaacatcagagagttcatactaaataaaagtattaaaagtgcaatcactgtcactagatctttcagaaaataaaagctgttaaagtacagaagaatatttattttgaggaaacacattataaatattaagagggttgtagtacatgtacttgtatcacagattttattgtacacattttgtactacaggaaaacctgaggtagttgttccaactttgctcaacatcagggaatttatattgaagaataaccctgcaaatttaataaatttggaaaaacattttttcaaaaactacagattataaaacacaaatgcgtttatactaaaatatgtttttgcagatacagtaaatataaaaaatatttaatccaaaattaagtttatgtaaatatcagctaattcacagtagaaatacctgtcactcaaacttcagatattacactaaatcagactgctgagtataggaaaaaatccaaaactaaagttggcaaaaagaagaattatttgtatataactttaaaagaagtagatctttgaagagttataattaaatttaaagtatacttttttcttcaaaacacagattttttttttttccagacacattggcttactgtggccaatactttgtgatgccaaggtgggcagatcacctgaggtcaggagttcaagaccagccttgccaacatagtggaactaaaaagaaatgtttactaaacatgtttactaaaaagaaataaagaaattagccaaggtctagcttccaggttcatgccattctcccacctcagcctcccaattagctgggactacaggcgcccgccgccactcccagctaattttttgtatttttagtacagatggggtttcaccatattagccaggacggtctctatctcctgacctcatgatatgcccaccttggccacccaaagtcctgggattgcaggcatgagccacagtgcctggcctaataacagaagtctttagcagagcaaaaatgtataaaatgtataatgacattgtataagtaataataaacctactaaccataaaaagccctggatcatatgaaatcacagcgaagttttaccacattgcaaagagttttacctaagcctactgaatgcattcgaaaaaatcaaggtgggatttcaccctaacttgttatattaaatcagtgaaatatatgaaactaaaatctagtgaaggcaccacaaaaaaaggaaagtacaggtcaatattctgggtgaatattggaataataatcctccatgaaatactagcaaactgaattcaaaagcaaatcagaaagttattttgctacattaatgtgagcttttccatatatatgaaggtgtttcatgatatggaagtcaataagtgtgattcaccatgtaaagataattaaaagaaaaaaaaataacagtaggggcagaaaaagcattcaagaaaacccaatattaactcaaaaatgttgtcaacacactggacattgatgaaaatatcttaataagagtcatctatgacaaatccttagccaacatcatactaaaagagcaaaaactggaagcattctccatgagaataaaaataagaatatccattctaaacagtcctattgaagttatgaaatcctagccagagaataaaaggaatccaaacagaaaacaaagaaagtcaaattatctttactgatgaaagaattgtccacctagaatactttaaaggtttcaccaaaagagttctaagcctggaaaaagacttcaaaaaaaatcttagaatacaaaatcagcacaaatgcatagcatttctgtacaccaataatattcaaactgagaacaaaataaaaaacacagctctatttacaatagcaacaaacacacaaaaaaatacctagaaatacattaaatcaagggggtaaaatatctctacaaagaacaacaaaacattgctgaaagaaacgagagacaatgcaaataaatggaaaaatattgctcatggattcaaataatataattaaaatggtcattctgcctaaagcaacctacagattaagtgctatttttatcagactatccatgacgatttttattgaattagaaaaagaaaactattctaaaatacattcaaaagaattaaagagctcaaatagccaagaaaacttcagactaaaagaataaatctgggccaagcatggtggctcatgcctgtcatctcagccctttgggaggctgagatggatggatcacctgaggtcagaagtttgagaccagcctggccaacatggtgaaacctgcatctctactaaatgtaaaaaattagccaggtgtggtggtgcatgcctgtaatcccagctacttgggaggctgaggaaagagaaccatttgagcctgggaggtggaggttgcagtgagccaagattgcatcagaataaccagtataacatggttctggtacaaaaataaacatctagaccaatgaaatggaagagagagtactgaattaagctatactttgcaatcaggttatttttacaaagccaacagaaataaacaaaaggggaattaactccctatttagtaagtaatactgggaaaactggttagtcatatgtggaagaaaactgtactacctttttctataaaaaaaaaacaactcaatatagattaaagacttgatctgtgagtctccaagctacaaaaatcttagaataacacttagataatactggcctctgtaaagaatttatgactaacatctaacatgagtgcaacaaaaataaaaataaaaaatggcatctaagccaaagagcttctgcacagtaaaagaaactatcagcaaagtaaacagatgacctacagtatgaaataaaatatttgcaaactgcagacaatgaaggattaatgtacagaatctataatacatttaataaaaaagcaaacatgatatgaatagccagcttcttctcaaaggaagacataagagctgccaataaacatgtaaaaattgctcaacgttcctaattatcagaaagatgtaaatcaaagtgacagtgtgatactatttcataccagtaagaatgacttattaaaagtaagataaataagatgttgaagttgtagagataaggaaatctttctacactgttggtgggaatgcaaattaattcagaacctgtgcaaagcagtttggggacttctcaaagaactagaaatagaattgccatttgaccaatcaagccgattactggatatctgcccccaaaaagaataaataattttgccaaagagacaccagcactcacatgttcattgcagcactattcacaatagcaaaaacagaatttaaccagttacccatgaatcttttattggataagaaaaatgatgtacttatacaacctccaatactatgcagcaacagaagagaatgaagtaacgtcttttgcagcaacatgaatgcagctctgcttcaggccattctaagcaaattattgcatcagaaaaacaaatgccacatgttctcactcatacatggatgctaaaaattgggcgcacatggaaacaaagatgaaaacaataaacactgagaattctaaaaagaaggaggaaggatgggagacaagcatagaaaatctgcttaggtatgatgtacactacttgggcaatggaattattaagtatccaaacctcaacatcatgtagtctacctgttttacaaatctgcacatgtaccttaaatataaaataaaaataataaaatgttttttggtataa

SEQ ID NO: 34977 - DNA, 120 bp, Homo sapiens
ggcaaaggctttagtatgttctcaatccttactaaacataaggcaactcatgctggagagaaaccctacaaatgtgaagaatgtggcaaagctttcaactggtcctcaaaccttatggaa

SEQ ID NO: 34978 - DNA, 3653 bp, Homo sapiens
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttaagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataatacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagttcccaaccctcctacacataagaaaattcatgctggagagaaactctacaaatga

SEQ ID NO: 34979 - DNA, 2810 bp, Homo sapiens
agaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagtt

SEQ ID NO: 34980 - DNA, 3283 bp, Homo sapiens
gcggaagtgggatctcctgggccgtagtgggcgttgtgtgtttcgggggcgggggcgggggcgggggccggggcggggacggggcctctggccgcctggctccaacatcaagcaccgggctccgagtggccgggatcagcgccccgaggcagaggccggagggcgcgcgcactgctaggaagtgctggtcccccgcgccgctctgccagcttggtcccccggcagacgcccctgtacgatcgccgctcgccccgcgggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagcccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatgtccagctccgtcggcactaccaccctgctccatcatcactacgtccagctccaacggcactggtgccccattccatcggcactaacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaaggactccccctcagacctccaaagggcaacagaagagtattaataaacgtgaaaactt

SEQ ID NO: 34981 - DNA, 1313 bp, Homo sapiens
atgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagcctttcggctgcagcgactgcggcaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagcccgtggggtgagcagctggcttggccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaac

SEQ ID NO: 34982 - DNA, 2681 bp, Homo sapiens
gagtgtctactccaagacctgggacttccgtttcggtccagccgggctgcggccattgtttgtgtggactgagtgttttggccatcccggtccactctcacaggctccgttaagtgacatgaactctcaggaggactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaagaaagcctgatctttgaccagatggcagtaacatttgaagatgtgactattatttttacatgggaggagtggaaattcctggattcttctcaaaaaagactctacagggaggtcatgtgggagaactacacaaatgtcatgtcagtagaaaactggaatgagagctacaaatcccaagaagaaaaattcagatacttagaatatgaaaatttttcctactggcaaggctggtggaatgctggcgcccagatgtatgagaatcagaactatggggaaactgttcaagggacagattccaaagacctcacacagcaagatcgttcccagtgtcaggaatggttaatactctccacacaagtaccagggtatgggaactatgaactgacttttgaaagcaaaagtctcaggaacttaaaatataaaaattttatgccttggcagtccttagaaacaaaaaccactcaagactatggtagagaaatctacatgagtggttcacatggttttcaagggggcagataccgtcttggcatatccaggaaaaacctctccatggaaaaagaacagaagctcatagttcagcattcttatatcccagtggaggaagcccttccacagtatgttggggtgatatgtcaagaagacctactgagagattcaatggaagaaaagtactgtggatgtaataaatgtaaaggaatttattattggaactcacggtgtgttttccacaagagaaatcaacctggagaaaacctctgtcaatgctccatctgtaaagcatgcttctctcagagatcagacttgtatagacatccaagaaaccacataggtaagaagctgtacggatgtgatgaagttgacggtaactttcatcagagctccggagttcactttcatcagagagttcacataggggaggtaccttatagctgtaatgcatgtggtaagagcttcagccagatctctagtcttcacaatcatcaaagagtccacacagaagagaaattctataaaattgagtgtgataaagacctcagtagaaattcattacttcacattcaccagagacttcacataggagagaagccttttaaatgtaatcagtgtggtaagagttttaatcggagttcagtacttcatgttcatcagagagtccacacaggagaaaaaccatataagtgtgatgagtgtggtaagggtttcagccagagctcaaatcttcgaattcatcagttagtacacacaggagagaagtcttataaatgtgaagactgtggtaaaggctttacccagcgctcaaatcttcaaattcatcagagagtgcatacaggagagaaaccttataaatgtgatgactgtggaaaggactttagtcacagctcagatcttcgcattcatcagagagtccatacaggggagaaaccctatacttgtcctgaatgtgggaagggcttcagtaagagttcaaagcttcacactcatcaaagagtacatactggagagaaaccctacaaatgtgaagagtgtggcaagggattcagtcagcgttcacatcttctcattcatcagagagtccatacaggagaaaagccctataaatgtcatgattgtggaaagggttttagtcacagttctaatcttcacattcatcagagggtccatacaggagagaagccttatcaatgtgctaagtgtggtaaaggtttcagtcatagctcagctcttcgaattcatcaaagagtccatgcaggagagaaaccttacaaatgccgtgaatattataagggatttgatcataattcacatcttcacaataatcatagaagaggaaacttataaatattgttcatttagttaacagctttaatcaaagtttacctaacctttaaaccctataaatcctgctgttaaggaaatcttataaataacacaagtaatcccaagcaacatttatagtttcccctatctcccactaagaattatttgcttcaaaaggagatctttagaaaaaaccctatatatttaaaattatagtgtatttttctttacctactataaatataatacagtcataaatatattaaacatttaaggagaaaactcttcattctatttcattctagtctttttttctgtgcattttaatgtgcatgaaattgtgtgttcaattttgtattttcactgtcttcaaaatatttacttaaattttggtttgaattgaaactggttggccaactgttaaacgacatctcttaactcccctaaaaactccctaggaagtaacagaaaagatggaaacacatagaacttaaaactcagttttggccggtagaattcaattgtttatggacaaaagccacctaataaaagataggaaagcatt

SEQ ID NO: 34983 - DNA, 2562 bp, Homo sapiens
gactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaaggaacctacctttgatcagcaaggaaggactggggtggcaaaggctcatgcccccattttacagcctgatctttgaccagatggcagtaacatttgaagatgtgactattatttttacatgggaggagtggaaattcctggattcttctcaaaaaagactctacagggaggtcatgtgggagaactacacaaatgtcatgtcagtagaaaactggaatgagagctacaaatcccaagaagaaaaattcagatacttagaatatgaaaatttttcctactggcaaggctggtggaatgctggcgcccagatgtatgagaatcagaactatggggaaactgttcaagggacagattccaaagacctcacacagcaagatcgttcccagtgtcaggaatggttaatactctccacacaagtaccagggtatgggaactatgaactgacttttgaaagcaaaagtctcaggaacttaaaatataaaaattttatgccttggcagtccttagaaacaaaaaccactcaagactatggtagagaaatctacatgagtggttcacatggttttcaagggggcagataccgtcttggcatatccaggaaaaacctctccatggaaaaagaacagaagctcatagttcagcattcttatatcccagtggaggaagcccttccacagtatgttggggtgatatgtcaagaagacctactgagagattcaatggaagaaaagtactgtggatgtaataaatgtaaaggaatttattattggaactcacggtgtgttttccacaagagaaatcaacctggagaaaacctctgtcaatgctccatctgtaaagcatgcttctctcagagatcagacttgtatagacatccaagaaaccacataggtaagaagctgtacggatgtgatgaagttgacggtaactttcatcagagctccggagttcactttcatcagagagttcacataggggaggtaccttatagctgtaatgcatgtggtaagagcttcagccagatctctagtcttcacaatcatcaaagagtccacacagaagagaaattctataaaattgagtgtgataaagacctcagtagaaattcattacttcacattcaccagagacttcacataggagagaagccttttaaatgtaatcagtgtggtaagagttttaatcggagttcagtacttcatgttcatcagagagtccacacaggagaaaaaccatataagtgtgatgagtgtggtaagggtttcagccagagctcaaatcttcgaattcatcagttagtacacacaggagagaagtcttataaatgtgaagactgtggtaaaggctttacccagcgctcaaatcttcaaattcatcagagagtgcatacaggagagaaaccttataaatgtgatgactgtggaaaggactttagtcacagctcagatcttcgcattcatcagagagtccatacaggggagaaaccctatacttgtcctgaatgtgggaagggcttcagtaagagttcaaagcttcacactcatcaaagagtacatactggagagaaaccctacaaatgtgaagagtgtggcaagggattcagtcagcgttcacatcttctcattcatcagagagtccatacaggagaaaagccctataaatgtcatgattgtggaaagggttttagtcacagttctaatcttcacattcatcagagggtccatacaggagagaagccttatcaatgtgctaagtgtggtaaaggtttcagtcatagctcagctcttcgaattcatcaaagagtccatgcaggagagaaaccttacaaatgccgtgaatattataagggatttgatcataattcacatcttcacaataatcatagaagaggaaacttataaatattgttcatttagttaacagctttaatcaaagtttacctaacctttaaaccctataaatcctgctgttaaggaaatcttataaataacacaagtaatcccaagcaacatttatagtttcccctatctcccactaagaattatttgcttcaaaaggagatctttagaaaaaaccctatatatttaaaattatagtgtatttttctttacctactataaatataatacagtcataaatatattaaacatttaaggagaaaactcttcattctatttcattctagtctttttttctgtgcattttaatgtgcatgaaattgtgtgttcaattttgtattttcactgtcttcaaaatatttacttaaattttggtttgaattgaaactggttggccaactgttaaacgacatctcttaactcccctaaaaactccctaggaagtaacagaaaagatggaaacacatagaacttaaaactcagttttggccggtagaattca

SEQ ID NO: 34984 - DNA, 3448 bp, Homo sapiens
tgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaagtgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaatataatgtaagaaaacatttgtcagatttttctttaaatgatatcacagaattaatgttggatagaaatatcattggatagaaatctgtttgaaggaattttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattaggcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactct

SEQ ID NO: 34985 - DNA, 3257 bp, Homo sapiens
agagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgcttgtgagtgactgaacgggccactggagaggagcggtgctcacggttgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaagtgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaatataatgtaagaaaacatttgtcagatttttctttaaatgatatcacagaattaatgttggatagaaatatcattggatagaaatctgtttgaaggaattttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattaggcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactctgtacaccagaa

SEQ ID NO: 34986 - DNA, 1396 bp, Homo sapiens
tagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaagatggagtttccctcttgttgcccaggctggagtataatgatgcagtctcggctcactgcaacctccacctctgggttcaagtgattctcctgcctcagcctcctgagtagctgggattagaggcacccaccaccatgcctagctaattttttgtgtttctagtagaaatggggtttcaccatgttggccaggctggtcttgaactcctgacctcaagtgatccgcccacctcagcctcctaaagtgctgggatgacaggcgtgagccaccacgcccagctgtcccttaacatttgaaatgtgtatatcacctcatttagctattctgtttctagaaacttatttttacaaagaaaattcacaaatgcacacgaaaatgtatgcatgaagatacttgtcacagcgttggttgtaataatatggaattaggtcaaatatttatcagtaaaagactaagtcatattgtgcatatactgaaatatgtgataaacctaaatttactgac

SEQ ID NO: 34987 - DNA, 5633 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgc

SEQ ID NO: 34988 - DNA, 5796 bp, Homo sapiens
attcaaacccggccggcccgagtggtgtcagctcagtcccggccgccgccgcgcgaggaaatggccgaggagccggagccgcagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttga

SEQ ID NO: 34989 - DNA, 3684 bp, Homo sapiens
tctgacccaacagtcccccagcgccggacgcgccgcgccccggcggctctagggaccccccgcgcctgcactgtccccgcgcggacgagtagggggcgcccgcgcctttgcccccgtgcgcacccccgccccgctcaccttagccccgcgcccgagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaa

SEQ ID NO: 34990 - DNA, 779 bp, Homo sapiens
accgttttaaggcttcatggtgatgagggcatttaaccctcgggacacgcccattctgcaggcctggctcgacctccactttggagaagatgctccaggaacactgaagggcaggtcgtccccgaccttctatgaggattgcccagctcaagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaacca

SEQ ID NO: 34991 - DNA, 3071 bp, Homo sapiens
gcaccccgcccctggcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctg

SEQ ID NO: 34992 - DNA, 2908 bp, Homo sapiens
atcaagaacggaaaggaccgaagagtaactttaataatgtttcttatacggccgacattaactatctctataatcgcccctcctcctcccccaaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgag

SEQ ID NO: 34993 - DNA, 2918 bp, Homo sapiens
ccactcttccaaggtgtcacaaacagaaaagagctgcagcggacgccactgcaatgtcaaggcaaggcagccaggctgcgctctatcctcactggtgcctggccctggctaggccgggagaagcagcattctctagggaaagaagccttctcaagtgggaacaaaaatgagtgtgaggcgaacagccatcccgggcactatgtgaatttgggctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggc

SEQ ID NO: 34994 - DNA, 560 bp, Homo sapiens
tttgagtatagcagccccttcgtgcctcaagaagcaagtagggagaatggattggttttgggaatacagaatgctgagagtctgggggtagggagtgactttactgctgaaaactagggctcatcttttcctccaaatctgtctcttgctttagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacacca

SEQ ID NO: 34995 - DNA, 798 bp, Homo sapiens
cctgcagagaggaggaaagcctgcctcggaacagccctggacaaaggggctcagatgccccatcatactgcaggctccaagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggccc

SEQ ID NO: 34996 - DNA, 654 bp, Homo sapiens
tgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacg

SEQ ID NO: 34997 - DNA, 546 bp, Homo sapiens
gtgcatgttggggcagaaagagcggcagagccaactccttccctggtcttccagaactttcaaaatcaaaatcggggttgcgttaggacatgcctctgggataagattccccatggtgggatggcagcagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgc

SEQ ID NO: 34998 - DNA, 2551 bp, Homo sapiens
gaaatcagactttggagccacaaagaaccattccaattctgggtcgtccgcttacacacggtgaacggagcacatttcttctctgagccttggttcctttcctgtaaatggagtataaccactcccatcttgcaggagctttttggtgataattaaggtgacttcgtgaaaagtaccagggtctcaaaaatctcaaaatttgtggaaagtatgcagtttctaggttggagaggctagagtttggtttcaaaagcctcgaccacacacaggggcggttacagctcttgaggtcccgggggtcacaggacgccttccgagttggggggaggagaaaacaaaaccacaggaagaaacgaacaacgctttcgggtgggcccgggaccatagagggtcgctccgccactttcctagagcgaccgcggcggcgccagagcgcggcgaggccctcacttccggcggcgcgggaggcgcccagcgagccagagtggtggctggtcccgcgcgaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgtagatacattttgagaaaaaccatcatgttttgaggatacatttgtgaaagtgcaggcatgccaatgactactcagttttaggactttctgtggaagaaaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatacta

SEQ ID NO: 34999 - DNA, 496 bp, Homo sapiens
aaaaggggcctcgtcggagagtagagctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctggg

SEQ ID NO: 35000 - DNA, 2902 bp, Homo sapiens
aaacattcggtggagtcgcggacacttccgctcggggactgaggttgctgcagtttttccgcgatagtttggggcagttccgcgcgttgcaggcccttctgaatttcctggacctacgcattggatcctcaaagaactgctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctgggaaaaaattgcaagtgatttaaccaggtctcaagacttgatgataaatagctctcagttctccaaagaaggtgatttcccctgccagactgaggcaggactatctgtaattcacacaagacagaaatcttcccagggcaatggatataaaccatccttcagtgatgtctcccactttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcataaattacacacaggagagaaaccttataattgtgaggaatgcgggaaggccttcattcacgattcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagaaaagccatataattgtaaagagtgtgggaagagcttcagatgggcctcgtgtcttttgaaacatcagcgagtccacagtggagaaaaaccattcaaatgtgaagaatgtgggaaaggattttacacaaattcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggctacaatagtaagtttaatcttgatatgcaccagaaggtccacacaggagagagaccatacaattgtaaggaatgtgggaagagttttggctgggcctcgtgtcttttgaaacatcagagactgcacagtggagaaaaaccattcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctaaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaatgcagtctcatctgaaagttcacaaaggagagacacattaaaatatgaggcacatagtaagcacttccctttgagtattttatctctgaatccatgctggtgataaatttcacccattcttggaagagggaaaacatttgtttaagataacatcagtgcttcagccatagctcagcatgccccagtagtctcaggaccaccataatggagaatccttgtaaatggtgcaataaagcttcattcagaagtttgataattacagctatcattcaggagacaggccttagaaagagtaagagttcatgaatttaccagactaatggtggacatgtccaaattgatgtccactagaatgtaaactacatgtgtctttgctgctaagtcgtcacagccttaacattgattagcactttgtatgtgttcagtacttgtttgttaaa

SEQ ID NO: 35001 - DNA, 2674 bp, Homo sapiens
gcacttccggcagcgccggggagcagtccgctacggagctccagcccttctctgagacggggaccaggggatggcagccatgcacctgacagcctggccccagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaa

SEQ ID NO: 35002 - DNA, 1248 bp, Homo sapiens
tgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaa

SEQ ID NO: 35003 - DNA, 3242 bp, Homo sapiens
cggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaagctccagcccttctctgagacggggaccaggggatggcagccatgcacctgacagcctggccccagggacttcacggatcccctgaagctcatccatggacttccatggactacagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaa

SEQ ID NO: 35004 - DNA, 3234 bp, Homo sapiens
cggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggctcaatagcttgcgcccattggaaggggaaacgcacgttgctgtcccagccacgaggccctgagcatttagcacttggtcgacgggggaagatgtgtcggtgcagctaaaagatggaatatttgcgggcgtgaagcggcccgaggtgataccacaagtcttttgacatgctgaggtctggcaggaacattaacctatgtgcatcccgagtatggaccgtgtgctcccaggctcctgacatagggtcatgaattagggccgagtgggagcgcagagcccctcccagtcacccggcagcagaagcagcccggcttttggaggacattgtctcctggagcagtgtcagtcccaaaagctccagcccttctctgagacggggaccaggggatggcagccatgcacctgacagcctggccccaggtgagctgtggggtccttcagctcttcctctgggcagtttcagattgaaaaacagggcctgagctatggaattggccctagggcagcaggaacctattgtttcagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttattt

SEQ ID NO: 35005 - DNA, 2785 bp, Homo sapiens
cacttccggcagcgccggggagcagtccgctacggagctccagcccttctctgagacggggaccaggggatggcagccatgcacctgacagcctggccccagggacttcacggatcccctgaagctcatccatggacttccatggactacagaagtcggtgacctttgaggacgtggctgtgtacttcacccaggcggaatgggatggcctgtcccctgcacagaggaccctgtacagggatgtgatgctggagaattatgggaatgtggcctccctgggatttccacttctcaaacctgctgtgatctcacaactggagggaggaagtgagctggggggctcatctccactggctgcaggaacaggcctccagggcctccagactgatggagtctcgctctgtcgcccaaactggagtgcagtggcaagaacttggctcaccgcaacttccgtttcccgggttcgagcaattctcctgcctcatcctcccgagtagctggaactacagtagatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttattt

SEQ ID NO: 35006 - DNA, 2358 bp, Homo sapiens
gtgacgcacttccggcagcgccggggagcagtccgctacggagctccagcccttctctgagacggggaccaggggatggcagccatgcacctgacagcctggccccagtagatattcagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttg

SEQ ID NO: 35007 - DNA, 8121 bp, Homo sapiens
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacatacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggacggggaggagctgagccggaccctccacctggaggaggtggtgcaggaggccgccggcgagtggcaggccctcacccacgtcttctgatgcgagttggaagtacacctttaagaatgtttctgaagttacgttttgtgaagagcaaagcacttggaatctccgttttaaagcttcaagtgttaaaaatgctacaatagttttttatctataaaattatctaaagaatcattgtctttcagagactcataggaaaaaaaaactaggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 35008 - DNA, 4872 bp, Homo sapiens
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttccaggtctgtgcagcacagtgtgggaccccaggagtgtggatctgtggaggcattgtatttggagaactccagcgacaagact

SEQ ID NO: 35009 - DNA, 8203 bp, Homo sapiens
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttccaggtctgtgcagcacagtgtgggaccccaggagtgtggatctgtggaggcattgtatttggagaactccagcgacaaaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacatacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggacggggaggagctgagccggaccctccacctggaggaggtggtgcaggaggccgccggcgagtggcaggccctcacccacgtcttctgatgcgagttggaagtacacctttaagaatgtttctgaagttacgttttgtgaagagcaaagcacttggaatctccgttttaaagcttcaagtgttaaaaatgctacaatagttttttatctataaaattatctaaagaatcattgtctttcagagactcataggaaaaaaaaactaggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttagg

SEQ ID NO: 35010 - DNA, 3851 bp, Homo sapiens
agtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaa

SEQ ID NO: 35011 - DNA, 2283 bp, Homo sapiens
ttagtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagaga

SEQ ID NO: 35012 - DNA, 2389 bp, Homo sapiens
ctagtcccgattatggttattacagtttgatgaaatgtggctgagatcattggcactgtggagattaagaaatgtgaggtcagagtgttgggtaaattgttcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttcaaa

SEQ ID NO: 35013 - DNA, 2067 bp, Homo sapiens
tgtatttcggggccctaggcgcgcgagcggtcagcatccggaatctggcccctgcaggcgtggggttccacgtgggaggaatccatcccctctgggagtaagaaatgaccagggtccgggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttc

SEQ ID NO: 35014 - DNA, 2039 bp, Homo sapiens
gcatccggaatctggcccctgcaggcgtggggttccacgtgggagaggaatccatcccctctgggagtaagaaatgaccagggtccgggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttcaaa

SEQ ID NO: 35015 - DNA, 2027 bp, Homo sapiens
ttgtatttcggggccctaggcgcgcgagcggtcagcatccggaatctggcccctgcaggcgtggggttccacgtgggaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttc

SEQ ID NO: 35016 - DNA, 1904 bp, Homo sapiens
ttgtatttcggggccctaggcgcgcgagcggtcagcatccggaatctggcccctgcaggcgtggggttccacgtgggaggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttc

SEQ ID NO: 35017 - DNA, 6307 bp, Homo sapiens
gcgccgggggcttctgggaaaaggcttgtgaacggcgtttctgcgtctgccgtggacagcgaagctgctgcggttcctgagccggaggtttgcgccggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcaatatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagtgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtcaa

SEQ ID NO: 35018 - DNA, 1255 bp, Homo sapiens
gaacggcgtttctgcgtctgccgtggacagcgaagctgctgcggttcctgagccggaggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcaatatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattg

SEQ ID NO: 35019 - DNA, 4139 bp, Homo sapiens
attggcgtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagggacccgtgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccctataaatgtaaggaatgtgggaaattcttctctaggaattcacacctcaaaactcatcagagaagtcacacaggagagaaaccctatgaatgtaaggaatgtaggaaatgcttctaccagaagtcagccctcacagtacatcagcgaactcacacaggggagaaaccctttgaatgtaataaatgtgggaaaacattttactataaatcagacctcactaaacatcagagaaaacacacaggggagaagccctatgaatgcacagaatgtggcaaatcttttgctgtgaattcagtcctcagattacatcaaaggactcacacaggagagaagccctatgcatgcaaggaatgtgggaagtccttttctcagaagtcacattttattatacatcagagaaaacacacaggggagaagccctatgagtgtcaggagtgtggggaaacctttatccagaagtcacaactcactgcacatcagaagacacacacaaagaagaggaatgctgagaagtaagatgagttgggaaattctcttgactgaattaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcatattttaggcttttctaaatattagataatatagatggcagaagtcatgcaaattgtaaaacaggaaggaaacctttcagaagtcatacttttgttttgcaacatagaagtcacacaggagaaaaatcctgtaagtaaaacgaatgtcaagacattttctgtcagggcagccagctgtagacatccaaaagctcacaaatgagaagctccttgagtatctagaaatctctttacacaattggagctcatgtactagagaattcaaagggataactgcaaagacactggtagatatagaagcctttattaagaattgatgtttcattcaatttcagatcactggtacttggatagatattttaaatatttggaaggtgttcaataaaaattcaaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaattataaggcatctttttatccttttttgtgtttgtaaatggatatagacagtggtaataactaatccttcaaaaataagttaaaatgtttttgtaaaattttcaaatgtcagtcaagttttgcattagggacacatttatatatagcaaaagcctgagctgtttttaaacagctaaaaacagtagtatttattacaatctccacaatgaaaacaaatagtgcaatgtaagaaatattatgtatcttactgttgatgtgtgagcagggagcagagctatctgcatttgtatttagtgtgagagtcctaaatgttcttcaccaactttttcttcctcatagaagcaacatggcatagttaagggtgtggactctgggctcctgctgcctgggccccgattccagcatggggcatgctacttaatatctctgtgcctcagttcccatcccataaaagagtagtgatagtgacaacatcttaggattgctttgaggtctaaatgagttaacattttcaaagcacttagaatagtgtctgagacacaagagctatatgttagaggttatcatcattatttgtattttgtgaattacgctgcaaaaaaaaaaaaaatgttggctacccaacattcattccccaccttcttgctgccagtgccttgatttggttgtttgttgtttgtttgttttcctacaagtgatttaggggcagatcctgactacactaagtcagggtttgacaaatgacagtccatcagacagatctggcccactacccatttttgtatcctgcaagctaagaatggttttatatttctaaatggttgaaagaatcaaagaatattgtgacacatgaaaattatatgatattcaaatttcagtgtccataaataaagttttgaaaacatgaatacaaacaaaaaacacctatttatgtttgacctgtggctgtctttgcactaccccagcagagttgagtagttgtagcagacaccacatgcccttgagcctaagatctagcactttacaaagtaagtttttctgttacttagagctgaaaataaaagcaatgtagagttacgcttttataagtatttcatgtttcagaaatgatgcatacagcaatttgtaggtgggtggttttttgcagtatatttattttgtgcattatatttatatgttaagagcctgagcttagaagtatttttttcaaagaaatgtgttttttacttgctaaattgtcataacatcaaaacaagaaatttcttgatggaatgtagcagtaaacatatgaaataaacattgtctaaattaagtcgaattgttcattgatactgccccacagtattcctttgttttctcccaaatcaatggccagttttccctgtatcattttataattttctttctatcccataagataccattggtaagtcatacttagctaacgtaacccaataacaaaaaacttacaatacccaattccatcagctacattactagtaatctataaaattattgcctgcacttcatgtaattgtcatatgctgctacaatctaaacctgccagcgtcttacttccccttcctaataaagactttcattgat

SEQ ID NO: 35020 - DNA, 3161 bp, Homo sapiens
gtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagaagaatccattgccaaattcaagggacccgtgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccctataaatgtaaggaatgtgggaaattcttctctaggaattcacacctcaaaactcatcagagaagtcacacaggagagaaaccctatgaatgtaaggaatgtaggaaatgcttctaccagaagtcagccctcacagtacatcagcgaactcacacaggggagaaaccctttgaatgtaataaatgtgggaaaacattttactataaatcagacctcactaaacatcagagaaaacacacaggggagaagccctatgaatgcacagaatgtggcaaatcttttgctgtgaattcagtcctcagattacatcaaaggactcacacaggagagaagccctatgcatgcaaggaatgtgggaagtccttttctcagaagtcacattttattatacatcagagaaaacacacaggggagaagccctatgagtgtcaggagtgtggggaaacctttatccagaagtcacaactcactgcacatcagaagacacacacaaagaagaggaatgctgagaagtaagatgagttgggaaattctcttgactgaattaatccttcaaaacaatcagataattcacacaagaggtacaccttatgaatcgcatcaatagagggaaattttcagctacaatctttgctctctctgtgtatcagcaaatacatagagagattctgtacatttatttgggagaaaattttatcatattttaggcttttctaaatattagataatatagatggcagaagtcatgcaaattgtaaaacaggaaggaaacctttcagaagtcatacttttgttttgcaacatagaagtcacacaggagaaaaatcctgtaagtaaaacgaatgtcaagacattttctgtcagggcagccagctgtagacatccaaaagctcacaaatgagaagctccttgagtatctagaaatctctttacacaattggagctcatgtactagagaattcaaagggataactgcaaagacactggtagatatagaagcctttattaagaattgatgtttcattcaatttcagatcactggtacttggatagatattttaaatatttggaaggtgttcaataaaaattcaaataatttgtactgagggaaacagttatactacaaatcatgttgcagatctgatgccgagattgctctattttaaaaggaaacctgcaaatgtctacatatatgaagcttttaaaaagcacaagttatcaggcaacatcattaaacatacattaaatgtctgttagcatataggattttgtgcgtatgtgagtgtgctataacatgtaacttgcggatgttcagcgtgcatgtggaatccatccataatggtacatagcgaaataatataatcttagttcagtaactattatgtgtatgaagatgttgcacattaagtctcagtagtgactctggttgttaatatttgtattgtaagtgtaatattccttttaaattataaggcatctttttatccttttttgtgtttgtaaatggatatagacagtggtaataactaatccttcaaaaataagttaaaatgtttttgtaaaattttcaaatgtcagtcaagttttgcattagggacacatttatatatagcaaaagcctgagctgtttttaaacagctaaaaacagtagtatttattacaatctccacaatgaaaacaaatagtgcaatgtaagaaatattatgtatcttactgttgatgtgtgagcagggagcagagctatctgcatttgtatttagtgtgagagtcctaaatgttcttcaccaactttttcttcctcatagaagcaacatggcatagttaagggtgtggactctgggctcctgctgcctgggccccgattccagcatggggcatgctacttaatatctctgtgcctcagttcccatcccataaaagagtagtgatagtgacaacatcttaggattgctttgaggtctaaatgagttaacattttcaaagcacttagaatagtgtctgagacacaagagctatatgttagaggttatcatcattatttgtattttgtgaattacgctgcaaaaaaaaaaaaaa

SEQ ID NO: 35021 - DNA, 2328 bp, Homo sapiens
ctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagccttt

SEQ ID NO: 35022 - DNA, 3519 bp, Homo sapiens
ctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaaccattaatgcctactcacatcttactgaacagaagaaggttcatagttaataaagcattaaaagtgcaattactgtcaaaaaatctttcagaaaatagaagtctttaaagtgaagaatatttattctgaagacagccattacaaatataaagggggttgtagtgcctttacttgtgtcacagatcttagtgcacacatgtagtactagaggaaaaccctgaagcagttgctcaagctttgtttcagggaatcaagggaatttatattgagaatagtactgcaaatgtaatgaatggaaagacttttcttttccaaaaatgacagcttagaaaacaccagagggtttataccaaaatatatttttgcagatgcagtaaatatcaaaaaatatttaattcaaaattgattctatgtaaatatcagagaattttccatagaataattaaggcactgacacttcagacattacactaaatcagaatgttcagtataaaaactaatccacagctacagctgttagataaattatttctatataattttttaaaaagtggatttttgaagcactgtaattacattgaaagtatacttgttttcttgaaaaaatttttttgaaaagtgaataatgatataatacagctttcacattgctttatgctattttattcctattatattcacatgtgaaagcatgtgatcaattgttgctgcattagagatattagagattgttttttattagttgggcattatgtatgaccttttctataaaagagtaaggacattaaaatgtaagatgcatgatgaaaatataagtggagaggctctttgtagttaactgatattaagtaatgtgtaaggtgggggttcatgttctcatttctataatcctagccaatgacttaatgttgatgctttgaatgtcttttggatggtctaacctacattaacatgtatgcggaacatcttaaaactttttttcaaaaatcataatgaattattttattaataagcaaagataaaaaataa

SEQ ID NO: 35023 - DNA, 511 bp, Homo sapiens
ggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggattggatttttcattactgtgaagaaaaacactggaattttgataaggagttctttaaatctacaggtcactttggataatatggcagtttcataatacttattctttcaatagaaataaaacattttaaaat

SEQ ID NO: 35024 - DNA, 3832 bp, Homo sapiens
accagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatattttt

SEQ ID NO: 35025 - DNA, 3975 bp, Homo sapiens
gggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatattttt

SEQ ID NO: 35026 - DNA, 1190 bp, Homo sapiens
gggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatga

SEQ ID NO: 35027 - DNA, 2205 bp, Homo sapiens
ggcgggacttccgttgtcctccttgtggcggtcgttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccagggcattgtgacctttgaggacgtggctgtttacttctcctggaaggagtggggtcttcttgatgaggctcagaaatgcctgtaccacgatgtgatgctggagaacttgacacttacaacctccctgggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagaagcaatgggggcagagacatgtttttgagcagctgcacatttgaagtatctgggaagcccttcacttgcaaggaggttgggaaggatttcctggtgagatcaagatttcttcagcaacaggctgctcacaccagaaagaagtcaaacagaaccaagagtgcagtggcctttcacagtgtaaaaaatcattacaactggggagaatgtgtgaaagctttcagctacaaacatgtacgtgttcagcaccagggagacctcattagggaaagatcttacatgtgcagtgaatgtgggaaatcttttagcacaagctgtagcctcagtgatcatttgagagttcacacttcagaaaagccttatacatgtggagaatgtgggaaatcctataggcaaagctctagccttattacgcaccgaagaattcacactggagtaagacctcatcaatgtgatgaatgtggaaaattatttaacaggaagtatgaccttcttatacatcagagagttcatactggagaaaggccttacaagtgcagtgaatgtgggaaatcctttagccatagctctagcctcattacacaccagagaattcatactggaatgaggccttatgagtgcagtgaatgtgggaaatcttttatccatagttctagccttattacacaccagagagttcacactggtacaaggccttatatgtgcagtgaatgtgggaaatcctttagccagagctgtcacctcattaaacaccggagacttcacattggagaagggccttatgagtgtagtgaatgtgggaaattgtttacttatagatctcgtttcttccaacaccagagagttcatactggagtaagatctcatgaatgtcatgaatgtggaaaattatttagcaggaaatttgacctcattgtacatgagagagttcacacaggagaaaggccatatgagtgcagtgaatgtggaaaatcctttacctgtaaatcctacctcatctcacactggaaagttcatactggagcaaggccttatgaatgtggggagtgtgggaaatcatttactcatagctctacgctccttcaacaccagagagttcacactggagaaaggccttatgagtgcaatgaatgtgggaagttttttagccagagctccagcctcattagacataggagaagtcacaccggagaaaggccttatgagtgcagtgagtgttggaaatcctttagtaaccactctagcctcgttaaacaccgaagagttcataccggagaaaggccttatgaatgcagtgaatgtggaaaatcctttagccagagctctaacctcactaatcaccagcgaattcacagtggggaaaggccttatgagtgtagtgactgtggaaaattttttaccttcaactccaacctcctaaaacatcagaacgttcacaagggataaaggttaggtaacacacatagggctgttacggactgagaagtgtccctgcaaaattcacagacataaataaataaatacgtattttc

SEQ ID NO: 35028 - DNA, 2169 bp, Homo sapiens
ctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaac

SEQ ID NO: 35029 - DNA, 3518 bp, Homo sapiens
ggcttccgggtttggcgggtactttgtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaaattatactagtgcgaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaatacaattactgtcaaatgatctttcagaaatataaacctttaaagtgaagaagagttcattctaaagacaaacattacaaatataaaggggtttgtagtgcttttacttgtatcacagattttattgtacacattttgtactagagaataaccctgaagcagttgctaaaattttgttcagcattaggaaatttatgttggagaagaattcagcaagtgtgattaatttggaaaaacattttttccataactatagcttagaaaatgccagagagctcatactaaaatatacttttgcagatgcaataaatacaaagaaatatttaattcaaattgagtttatataattatcagagaattaacagtagaaatagctaaggcactgacacttcagacattacactaaatcagattgctgagtatagaaaatccaaaactacagttggtaagtaaattaattttatgtaactttaaaatgagtagacatttctttgagaagtcataattaaattcaagtatacttttttgataaaattataaagctttttaaaagtaaataatgatgtaagtcaactctcaaattacttcatgctgtttcttcatttctattgtattcacctgtgaaagcatgtgatcaactattgctgcatcagagatatgagagatactttattaggtgggaattatatacgacctcttctataaaatagtaaggacactgaaatataagatgcataagagtctaagtgaagaggttctttgtggttaacttagtgatgtatgaagtagttgctcatgttatgagagaaaaacatttttaattttagttaaatgtaagttaaaattaaaatagtaccatataatgttagtgattgtacttttatttaataaaatgcagtacatttt

SEQ ID NO: 35030 - DNA, 3874 bp, Homo sapiens
gtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaaattatactagtgcgaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaatacaattactgtcaaatgatctttcagaaatataaacctttaaagtgaagaagagttcattctaaagacaaacattacaaatataaaggggtttgtagtgcttttacttgtatcacagattttattgtacacattttgtactagagaataaccctgaagcagttgctaaaattttgttcagcattaggaaatttatgttggagaagaattcagcaagtgtgattaatttggaaaaacattttttccataactatagcttagaaaatgccagagagctcatactaaaatatacttttgcagatgcaataaatacaaagaaatatttaattcaaattgagtttatataattatcagagaattaacagtagaaatagctaaggcactgacacttcagacattacactaaatcagattgctgagtatagaaaatccaaaactacagttggtaagtaaattaattttatgtaactttaaaatgagtagacatttctttgagaagtcataattaaattcaagtatacttttttgataaaattataaagctttttaaaagtaaataatgatgtaagtcaactctcaaattacttcatgctgtttcttcatttctattgtattcacctgtgaaagcatgtgatcaactattgctgcatcagagatatgagagatactttattaggtgggaattatatacgacctcttctataaaatagtaaggacactgaaatataagatgcataagagtctaagtgaagaggttctttgtggttaacttagtgatgtatgaagtagttgctcatgttatgagagaaaaacatttttaattttagttaaatgtaagttaaaattaaaatagtaccatataatgttagtgattgtacttttatttaataaaatgcagtacattttaaaatttttagattatttgtggacttaatttataattaaatattttcttttaccacgttaagactattgtacgttcaggccgggcacagtagctcacgcctgtaatcccaacactttgggaggctgaggcgggcggatcaattgaggccaggagtttgaaaccagcctggccaacatggtgaaaccctgtctctactgaaaatacaaaaaattagccaggcatggtggtgggtgcctgaaatcccagctatttgggagattgaggcaagagaatcacgtgtacccaggaggcagaggttgcagtgagccaagatcacgacattgcactccagcctaggcaacaagagcaagacttcgtctcaaaaaaaaaaaaaaaaaaaa

SEQ ID NO: 35031 - DNA, 3066 bp, Homo sapiens
gtggccgcggaggcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtctgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacaccggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatgtcttttgcttttt

SEQ ID NO: 35032 - DNA, 4853 bp, Homo sapiens
tatgttctgctgatttcagtgctcaccgttgtatccagcttcccaccaattctttctgtgtcttaatgttgtctctatagggtgtaattttttttttttagagacagagtctggttctgttgcccagtgtaaagtgcagtggcatagtcatggccaactacagcctcaaactcctgtgctcaaaccatccttccacctcagcctcctgagtaactgggactacaggcgtgcaccactatgcccacacatttttttgttatttgtagagatgaggtctaactatgtgacccaggatagtctgaaactcttggcctcaagtgatcctcccgcctcagcctcccaaatgctgggattataggcatgaggtaccacatttgatggatataaattttccaggtgctagtatatttgaaaatgtcttttattttcccttatttttgctttttagtttggctggtataagatttcagaatcagcattattttttctcagtactttatttctctcccactttcaagaagcattgttctttccttttagttggttatcaggtgttctctttatactttattttcagacatttcattaccatctgcttaaatttggaccttttttttgtttgttaacttatcttgtatttcaattggtaggtttttctcatgtgaactcctgtatttgtcttcactccaagagaattttcaggccgcatttctttgaacattgccctattatttctcttatttatataaacctacattggtaattcttctataaaccaggaaaatcattccaggtttatttatttatttatttttttgagacggagtcttgctctgtcgctcaggctggagtgcagtgatgcgatcttggctcactgcaacttctgcctctctggttccagcgattctcctgcctcagccttctgagtagctaggattgcaggtgcccacccccacgcctggctaatttttgtatttttagtagagacggggtttcaccgtgttggtcaggctggtcttgaactcctgaccttgtgatccgcttccctcggcctcccagagtgctgggattacaggcatgagccaccacacccggccaggtttattttgtagtctagctcttacctgttcacctgttgtagccatcgctgtggtttgagtgtatcttccaaatttcatgtgttggaaatttaattcctaaatttatttgttgatggtatttggaggtgggacctttgggaggtatttaggatttgataaagtcatcagggcagggcccctatgatgggattagtagccttaaaaggataggaagagagacctgagctggcatgctgtctgtctctcatcatgtattgccttccaccaagttatgacatagcaagaaggccctcaccagatgccagcaccatgcttatggacttcctggcctccagaaccttgagctaaatgaacatttttctttataaattacccagtttctggtattctgttataaaaatagaaaacaaagacagcagtcttttcggtgtctgaaatatttgttgttccttgaattgaccaggctctaccatgtgttctgtgtgatgcttgcttctggtacagggactgcaaattatgttccatctatttttttttctttctttcataatagatttgccagtttttcagttgggcatatacagaaactccatttctgaatttccctgctgttccctcccagcccccactctttgctgttgcttagaatgcagatgtgatgactagagccatcttagactgggttgccctggaagtggaagccatgtaaggtggagcaagagatggaagccccagaccaattgccttcagactcctgcaagtagaaggataaactctcttgtttatccccctgttctcagctgaacctcgtccaaacacctcctgaattgccctttctaccccaacttcttgaacacatcatgaatcttctaagactacttgagtggctctcttcatttctgtacaaaatgtaccctggatgtttttaccaaggactcagaacaccttattttgtttgcatgtataaatgttcattcccatctacaagatagaaagtttcttgaagacagaactggattttattcatcctgaaatcttcaggacccaagagagtaccggcaaatagaagctccttgattgattttttctttctttcttttttttttttttagatggagtctcactctgtcgccgaggctggagtgcagtggcacgattttggcttgctgcaacctctgctgcctgggttcaagtgattctcctgcctcagccacctgagtagctaggattacaagtgcctgccactgcgcccagctaatttttgtatttttagtagagacagggtttcaccatcttggtcaggctggtcttgaactcctgcccttgtgatccacccgccttggcctccgaaagtgctggcgtgagccaccgtgcctggcactccttgattgatttttaattctctcacaaagtaaatgctgaaccagccacaggaaatagttggtagaggaacatttatcccttcccagttcctctgcatcttttccatgtcacctaatgtaattgcatccaattgaacagggtgtgtgttatttcagggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacaccggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttc

SEQ ID NO: 35033 - DNA, 5666 bp, Homo sapiens
ccggcttgagcccagccaaagggattaccctcattcccgaaccgtgtctgagagtctcctggggttcctggcttagtatcgcaccgtggctgttacataaagtcagcacagcgtgtttaagctgatgttacaccactacccaatcccagggatagagtaaactaagactaaggccttacacccctgccccggccagggagacagtcccacaagctctggcggaggaaaagttcgcgcgaaaagctgactcaaaccgctgaaccttctgggaaatgtagtctaccctcaaaagagtggcacggaggacgggccaagatctctcgattccgtccggttctgagtcggggcctggcccagcccaggagacctctgggagcgctgcccgcggaaggagtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaattcatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgagaattcatacaggtgataagccttatgagtgtaaggtctgtgggaaagccttctgtcaaagctcatctcttactgtgcatatgagaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcacatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctactaatgatttttttttttttttgagacggagttttgttcttgttgcccaggctgcagtgcaatggcacaatcttggctcactgcaacctctgcctcacaggttcaagtggttctcctgcctcagcctcttgagtagctgggattacaggcatgcgccaccatgcccggctaattttgtatttttagtagagacggagttgcaccatgttggccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaatctaaactgtcttcttctgttcctcattttgctttacttaaataatctttcatattttttaagtgttttgcccatgtgcttgggtagccttgaagtcaccagaataactaggactcaaattcagaccaaaccaggactagctttttgtgccatgagttagccatggtcctggacccagcaaaaagaatgattatgatggtcagagtaagatgagcaattgcaacataatattctctaatattgtatactgtaaatttattcagctgccctcgtttactcacagtttgcttatttgccaccataagaaatggtacaataaaaattcatgtaatc

SEQ ID NO: 35034 - DNA, 5055 bp, Homo sapiens
agtgcgcaggcgcggaatctccgacttgccatggtcgtctttgtctgccggcctgcttccttgtatatccacaggagctgcaaaacctcttagagttctaagggcgctccctgaattttgggatgctgctttgttccccaaccataacatccaagtccagtgtcatttttctgctcacaagtttaaagtcagcacttaaaagaacagcaacagatgattgagaaagaaatgtaaagaaggttctctttgtgtgagtaagcaagaacctgaaaataattcttccgggccgggtgcggtggctcatggctgtattcccagcactttgggaggccaaggcgggtggatcatgaggtcaggagttcaagaccagcctggccaacatgaagaagcctgggaagtttataaacagataaagacgcaacatgaaagacttgtaagttaagtctcatctttctctgtgaaaagacagactgagggaaaatttaggaaacaaagtatttcctctgaacagtcattgattcttcaagactacccttctgtgtatggaactcagtttaaaagaatttgaaacctaatttatatacaatctatacctaaatatgggagaagctatataagaaccattaagaatataaagagaatgttacattttatccctttttgtaatcatctcatctcagggtaatcaatgtgagaaaagtcttccatcataaatttaacttcattagatacctgagaattaatattgaaaatacaccatatgaatttagtgaatgtgggaaagctttcatccttattacatcttatttgatactagggaaatctcctgattaaattcacatgcatgataggcatgttggaaagtcttcagcatgaatcagatctccttcagcatgatcaaattcatactggagagaaaccttatgaatgtaatgaatgtagaaaaacttttagcctgaagcaaaaccttgtagagcataagaaaatgcatactggagagaaatctcatgaatgcactgaatgtggtaaagtgtgctctcgagtctcatctcttactctacaccttagaagtcacacaggaaagaaggcatataaatgtaataaatgtggaaaagccttcagccagaaggaaaacttcctttctcatcagaaacatcacactggagagaaaccttatgaatgtgaaaaagtttctattcagatgccaaccatcatcagacaccagaaaaatcatacaggaaccaaaccctatgcatgtaaggaatgtggcaaagcctttaacggcaaagcatatctcactgagcatgagaaaattcatactggagaaaaaccatttgaatgtaatcagtgtggaagagccttcagccagaagcaatacctcattaaacatcagaacatccatactggaaagaagccctttaaatgtagtgagtgtggaaaagcttttagccagaaggaaaacctcattatacatcagagaatccatactggagagaaaccttatgaatgtaaagggtgtgggaaagctttcattcagaagtcaagcctcattagacaccagagaagtcacacaggagagaaaccttatacgtgtaaggaatgtgggaaagccttcagtggcaagtcaaatctcacagagcatgagaaaattcatattggagagaaaccctacaaatgtaatgaatgtggaacaatcttcaggcagaagcaatacctcattaaacatcacaatattcatacaggagagaaaccctatgaatgtaataaatgtggaaaagccttctctcgaatcacatcacttattgtacatgtgagaattcatacaggtgataagccttatgagtgtaaggtctgtgggaaagccttctgtcaaagctcatctcttactgtgcatatgagaagccatacaggtgagaaaccctatggttgtaatgaatgtgggaaagccttttctcagttctcaacccttgctctgcacatgagaatccatactggtgaaaaaccttatcagtgtagtgaatgtgggaaagctttcagccaaaagtcacatcacattagacaccagagaattcatactcattaaagttctctatgaatgccttggatttagcaaaacgttcagcagattttacacttaatagtgtattggaaaattcattttacattaaagtgacatgaatgtgggaagtccttcagcagcaattcaaaacttaaatactatgatgtttaataagtattatagtgtaaagaaaacccgtacccccaaaactcccacaacaagcattatcaatgctgtacttctaggagtatactcattaaagttaggatctagtcatggacactacttaatgtgttcctggaaggcctacagatgcattaagaaatagatatgagatgtatgaggatttgaaattaagagacaaaattatcatttttgtgatgttttgctacatatatgaattgtaaaactagaatcatcaaaattatttgttgttgaagcagtcataaaactgagactgagacagaatattgaattcagaaatgtgtgcatgaatatatggggaattggtaattgatagaggcggtatcccagattggtggggaaatcatggattacttaaaaattaattgactcttcatatggaaaaataatatctcccatcataatataaaatatttttcttatgaattcttaaagtactaaagactaaaatgcaaaaagcaatacttaataatataacagttttataagaagatgtttttaaaaccttagggcaggaaagaacttctaaaacattccagaatacccggtagttccactcttgagtatggtagtcccctattttctgcaagagatggactctaagacccccagtggatacctaaaacccagataggaccaaactctatgtctatgtttttttcttatatatacatacctatgataaaatttagtttacagattagacacagcaagagatttaaaacaataataaacataatatggaacaattataacaatatactgtaatcataaaagttatgtgaatatgatctttctctcagaataccttattgtactgttctcaactatttatgaactgtggtgactacaggtaactgaaaccatggaaagcaaagctgtggataagggggaactactatatatatgcatctacccaagaaacatgaacacagggagtcatgtactggtctatagctgtatagttcattgcaccatgagttatagtagccagaagttgggaaacaaatgctgtctcttgtgaaatagatgaataaaatgtgatagtaacatagtagagtactctctagcagttaagtgacaaattaagtctatatattaacagaaatatttttaaaaaattagagtgaagaaaaatgatgaacatattgtaatgatgcttctgtgaatttgaataaaatcaacactaaccagccctagtactaagaattggttatggataaattatgtaaaactaaagaatggattgaaaggatatgtatatactcagttcccaaaagtggagtggttacctctaggaagaaaggaggtggaagggaaatgttaccaagcatggtagttaaaggatacttcaattttgtatctatttcttattaaaaagaaacattctaagtaaacataacgaaatattaattctgggtggtggtaatatttgtgttcattctatcattcgtgctatttatttccttaaacttctgaaagttaaaaagtccagataggagtgaggaagctgtacatgaaacataatggacttacattcctagtcagatactaatattctgtagaagatatttctaaaatcttatctttaaaatatgaaataatttttaattggggtggcaacttaaattcaattaaaataactcatgtgtcacaagagtaaattttacataatctgtacgtagttctaatctgtatatagtcttggaggttatgatttgccacagattggttggatcacatacatttaaggatcatattattaaataatatatgcacagacatggagagaattagtttttactaaaacatttatcagaaattttaatactctgcataaccagtattagcattagaaattagccacttttaaaatgagaaaactgtgtcactcttcaatttttttataagccattgaggaaaacattaactcctggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctactaatgatttttttttttttttgagacggagttttgttcttgttgcccaggctgcagtgcaatggcacaatcttggctcactgcaacctctgcctcacaggttcaagtggttctcctgcctcagcctcttgagtagctgggattacaggcatgcgccaccatgcccggctaattttgtatttttagtagagacggagttgcaccatgttggccaggctggtcttgaattcctgacctcaggtgatccacctgcttcggcctcccaaagtgctaggattacaggtgtgagccaccacgcctggctaattttgtatttttagtagagatggggtttctccaaaggctggtcttgaactcccgacctcaggtgatccgcccaccttggcctcccgaagtgctgggattacaggcgtgagccaccgtgcccggcctgatgtttttgaatgattatgaaaatgggtatacagcattaaaaccttagactgattttaaatatattaatttcttttaaactcaatataatgttaatattactgtagcacttactagcatttctgaaggttggtcttgagataagattgaaaatgacagttgttgattttctgaggtaatatacccaaataaaatatatgtatgtgtacatgaa

SEQ ID NO: 35035 - DNA, 12161 bp, Homo sapiens
attttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatataccttttatttcctttttgtttgtcttattgcattgcacaagctgggacttccattatagcgttgaataggaatagtgagaaaggccatccttacctggttcctgatagtaggggggacaatgttcagttttttgtttttttgttttttgtttgagacagggtctcgctctgtcacccaggctggagtgcagtggcacgatcttgtctcaccatagccttaagttcctgggctcaagtgatccccccacctcagccctcaccaccccccagtagctggtactacaagcatgcaccaccagtcccagctaatttttgtattttttggtagagacagggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaagtcctgaacataggccgggtgcagtggctcacgcctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaaaattctctagctctctatgccttgttgtatcctcaggaaggagtcacctctcttccaggatcactcttgccttttgttattggacacattttcctacctcctgcccagtcttttttaggctctctgtcatacttcctcgcctagtctttaacttgtctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcagtgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctagccaacatggtgaaatcccatctctacaaaaatgaaaaattagccgggcgtagtggtacatgcatttagtcctagctacttgggaggctgaggcaggaaaatcgcttgaacctgggaggcagaggttgcagtgagccgagatcatgccactgcactccagcctgggtgacagagtgagactgtgtctcaaaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctctatatatatatatgtatatgtgtgtgtacatatggaccacttcaagctacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattgg

SEQ ID NO: 35036 - DNA, 2078 bp, Homo sapiens
acgccgttgccaccgaggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaacctt

SEQ ID NO: 35037 - DNA, 3320 bp, Homo sapiens
gctttctccgcgccgccaaacccgttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactggtccttcatccccccaatctcccgtacctggcgagtccagctcgtcgcggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattgtgtttatctagcatctgctcaagagtgtgctgcagtggagggaaatcagatgacctcccagtctggttgtgttacatacaatcatgtgtaagaagtgccattcaagccgtgtcactggaggggactgacagtgagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatc

SEQ ID NO: 35038 - DNA, 3600 bp, Homo sapiens
gctttctccgcgccgccaaacccgttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactggtccttcatccccccaatctcccgtacctggcgagtccagctcgtcgcggcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccagtagagatggtttcagcatgttggccagtctggtctcagactcctgacctcaagtgatccacccacctcggcctcccaaaatgctgggattacaggtataagccactgtgcctggccaaagataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattgtgtttatctagcatctgctcaagagtgtgctgcagtggagggaaatcagatgacctcccagtctggttgtgttacatacaatcatgtgtaagaagtgccattcaagccgtgtcactggaggggactgacagtgagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatc

SEQ ID NO: 35039 - DNA, 3293 bp, Homo sapiens
ggagccgtttcgggatctgtcaaacaacgagttttcgtcgttcgaatcaggttgactggtccttcatccccccaatctcccgtacctggcgagtccagctcgtcgcggcctgtacctccccacagagcttcaaaacgggcttttaggaagaaggaatggaggctttgaagcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccaggtttgacagagataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctccttcaaggactgagtccctagtcgaattcccggaaggagtggagcctgtcatattgtgtttatctagcatctgctcaagagtgtgctgcagtggagggaaatcagatgacctcccagtctggttgtgttacatacaatcatgtgtaagaagtgccattcaagccgtgtcactggaggggactgacagattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcttttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaactgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaa

SEQ ID NO: 35040 - DNA, 3261 bp, Homo sapiens
ggagagcaggggcggcttccgggatttggcgggggccttcgtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctgtaaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacatcatcgaattcatactggagaaaaaccatacaaatgtaaagcatgtagcaaatcttttagtgactcctcaggtcttactgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcatgt

SEQ ID NO: 35041 - DNA, 2024 bp, Homo sapiens
gtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcatgt

SEQ ID NO: 35042 - DNA, 3543 bp, Homo sapiens
atgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataaggg

SEQ ID NO: 35043 - DNA, 1374 bp, Homo sapiens
ggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttca

SEQ ID NO: 35044 - DNA, 5629 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaccaacctgttattatatcttaatattaattttgaagaattatttcttttaggaatcattttaagaaattttattccaggtgttccaaaatttcaggaaaaggtttgagaaaattctcaattataaataataagatacagattatttcattgtacaagtgaatctagtaaggaggttaagaataagaaataacatcccagagcctacagggatatttagatatcttcctatgtgtactacataatatgaattttgcagtttggcattttacttgcgaatgccatatgtgagacaaaaatcatcttccagagatttcagtatctctgatactgacaatatctctgatatgacaatatcatcttccagagatttctactctgcataccaacattgtttctttgtgtcttaccaaatgcaacttgttactagaatatgacttactaaaaatgcatttccacactgcaaacattttttagggctatcttctgccctttggaagcagtcttggcagcaacctctttagtaatcaatataaggcacacttcatgtgtttgtgtagcctggaatctattctaccttcacaggttagaacatcttgatttcctcttaacgaaacattccctaacggtgtatgtagtcatgagggaaccaccattcaagatgccctgctcaggacttggcatgagcactatggtcagctgaggctcagaactgtacattgttaatgggtttttcaagttcagaaaagcaacatgagcttttgttctgtggtagcatgttgatgtaataagtagctatttcaatagaggttcccagaacagcttttgttactgtcattttcttaactttgttcacttgtcttttattttgagctattgggtgtgcttttaatacattccttgtttgattgcattagccattgtgtatcttttgcatacagcttactaaatcagatggcttcagaaatgggtggtagaggagtaggcagaaacttgcaaggatatgtggatatttggaaatggttgtttcccaagacaggatggaagtcttttaagcaagaaacttggcccatgctatgaagtcatgaaatgaattgttggcatcatgtgctcactgaggctttggggaaatggataagttgtcattgaaaaattttaaacagaattctggagtggtcaagaggggaatgcttttgatacccatgtataacatggagaataatgatcttaaaacttcaatttaagattatgtgtcagtgatactacttagttacatgtagctatagagtcacagtggtgaaaaactctgccagttgcttactcacaaagttagttttcttcactacctcatcaggtttgttatgtgagtgggcattaatctgggaagagtgggaccctgccagttagattagggctatcttggaggaatatgcggattcaatactgcaaatatttctgaaacaccttctgctttgtactctattagatacccaaagaaattttcatccttgaagcggaggaatttaatgatacctgaatgcctaactgttgtattctgcttatacagaatccaatctcaagatacttggggtgaagaatgatgattcacagaagggaagggacatcttacataaacaaataatcgcagatacttgctaaagtgtatcccccaatctgggaaatactgtaaaggtgtatattattattgatgtaccaaagaagacagaataaattcataagagaaagtttatattcagtttactactacctagggttagattttagtttgttgttttttcagatgcaaatctacatgcagccttgcctggtagaagccagaagtgttgacagtattgaggacagcactcacatactgtgggaaagaataatacttgattaggacttattatttaatgaaatgaaaattttacaaaacagaaa

SEQ ID NO: 35045 - DNA, 3236 bp, Homo sapiens
gttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaa

SEQ ID NO: 35046 - DNA, 4721 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaccaacctgttattatatcttaatattaattttgaagaattatttcttttaggaatcattttaagaaattttattccaggtgttccaaaatttcaggaaaaggtttgagaaaattctcaattataaataataagatacagattatttcattgtacaagtgaatctagtaaggaggttaagaataagaaataacatcccagagcctacagggatatttagatatcttcctatgtgtactacataatatgaattttgcagtttggcattttacttgcgaatgccatatgtgagacaaaaatcatcttccagagatttcagtatctctgatactgacaatatctctgatatgacaatatcatcttccagagatttctactctgcataccaacattgtttctttgtgtcttaccaaatgcaacttgttactagaatatgacttactaaaaatgcatttccacactgcaaacattttttagggctatcttctgccctttggaagcagtcttggcagcaacctctttagtaatcaatataaggcacacttcatgtgtttgtgtagcctggaatctattctaccttcacaggttagaacatcttgatttcctcttaacgaaacattccctaacggtgtatgtagtcatgagggaaccaccattcaagatgccctgctcaggacttggcatgagcactatggtcagctgaggctcagaactgtacattgttaatgggtttttcaagttcagaaaagcaacatgagcttttgttctgtggtagcatgttgatgtaataagtagctatttcaatagaggttcccagaacagcttttgttactgtcattttcttaactttgttcacttgtcttttattttgagctattgggtgtgcttttaatacattccttgttt

SEQ ID NO: 35047 - DNA, 2193 bp, Homo sapiens
atggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcactgaatgtgggaaagccttttgttggaagtcacagctcattatgcatcagagaactcatgtagatgacaaacattga

SEQ ID NO: 35048 - DNA, 5428 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaccaacctgttattatatcttaatattaattttgaagaattatttcttttaggaatcattttaagaaattttattccaggtgttccaaaatttcaggaaaaggtttgagaaaattctcaattataaataataagatacagattatttcattgtacaagtgaatctagtaaggaggttaagaataagaaataacatcccagagcctacagggatatttagatatcttcctatgtgtactacataatatgaattttgcagtttggcattttacttgcgaatgccatatgtgagacaaaaatcatcttccagagatttcagtatctctgatactgacaatatctctgatatgacaatatcatcttccagagatttctactctgcataccaacattgtttctttgtgtcttaccaaatgcaacttgttactagaatatgacttactaaaaatgcatttccacactgcaaacattttttagggctatcttctgccctttggaagcagtcttggcagcaacctctttagtaatcaatataaggcacacttcatgtgtttgtgtagcctggaatctattctaccttcacaggttagaacatcttgatttcctcttaacgaaacattccctaacggtgtatgtagtcatgagggaaccaccattcaagatgccctgctcaggacttggcatgagcactatggtcagctgaggctcagaactgtacattgttaatgggtttttcaagttcagaaaagcaacatgagcttttgttctgtggtagcatgttgatgtaataagtagctatttcaatagaggttcccagaacagcttttgttactgtcattttcttaactttgttcacttgtcttttattttgagctattgggtgtgcttttaatacattccttgtttgattgcattagccattgtgtatcttttgcatacagcttactaaatcagatggcttcagaaatgggtggtagaggagtaggcagaaacttgcaaggatatgtggatatttggaaatggttgtttcccaagacaggatggaagtcttttaagcaagaaacttggcccatgctatgaagtcatgaaatgaattgttggcatcatgtgctcactgaggctttggggaaatggataagttgtcattgaaaaattttaaacagaattctggagtggtcaagaggggaatgcttttgatacccatgtataacatggagaataatgatcttaaaacttcaatttaagattatgtgtcagtgatactacttagttacatgtagctatagagtcacagtggtgaaaaactctgccagttgcttactcacaaagttagttttcttcactacctcatcaggtttgttatgtgagtgggcattaatctgggaagagtgggaccctgccagttagattagggctatcttggaggaatatgcggattcaatactgcaaatatttctgaaacaccttctgctttgtactctattagatacccaaagaaattttcatccttgaagcggaggaatttaatgatacctgaatgcctaactgttgtattctgcttatacagaatccaatctcaagatacttggggtgaagaatgatgattcacagaagggaagggacatcttacataaacaaataatcgcagatacttgctaaagtgtatcccccaatctgggaaatactgtaaaggtgtatattattattgatgtaccaaagaagacagaataaattcataagagaaagtttatattcagtttactactacctagggttagattttagtttgttgttttttcagatgcaaatctacatgcagccttgcctggtagaagccagaagtgttgacagtattgaggacagcactcacatactgtgggaaagaataatacttgattaggacttattatttaatgaaatgaaaattttacaaaacagaaa

SEQ ID NO: 35049 - DNA, 5661 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaaaataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctataagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaccaacctgttattatatcttaatattaattttgaagaattatttcttttaggaatcattttaagaaattttattccaggtgttccaaaatttcaggaaaaggtttgagaaaattctcaattataaataataagatacagattatttcattgtacaagtgaatctagtaaggaggttaagaataagaaataacatcccagagcctacagggatatttagatatcttcctatgtgtactacataatatgaattttgcagtttggcattttacttgcgaatgccatatgtgagacaaaaatcatcttccagagatttcagtatctctgatactgacaatatctctgatatgacaatatcatcttccagagatttctactctgcataccaacattgtttctttgtgtcttaccaaatgcaacttgttactagaatatgacttactaaaaatgcatttccacactgcaaacattttttagggctatcttctgccctttggaagcagtcttggcagcaacctctttagtaatcaatataaggcacacttcatgtgtttgtgtagcctggaatctattctaccttcacaggttagaacatcttgatttcctcttaacgaaacattccctaacggtgtatgtagtcatgagggaaccaccattcaagatgccctgctcaggacttggcatgagcactatggtcagctgaggctcagaactgtacattgttaatgggtttttcaagttcagaaaagcaacatgagcttttgttctgtggtagcatgttgatgtaataagtagctatttcaatagaggttcccagaacagcttttgttactgtcattttcttaactttgttcacttgtcttttattttgagctattgggtgtgcttttaatacattccttgtttgattgcattagccattgtgtatcttttgcatacagcttactaaatcagatggcttcagaaatgggtggtagaggagtaggcagaaacttgcaaggatatgtggatatttggaaatggttgtttcccaagacaggatggaagtcttttaagcaagaaacttggcccatgctatgaagtcatgaaatgaattgttggcatcatgtgctcactgaggctttggggaaatggataagttgtcattgaaaaattttaaacagaattctggagtggtcaagaggggaatgcttttgatacccatgtataacatggagaataatgatcttaaaacttcaatttaagattatgtgtcagtgatactacttagttacatgtagctatagagtcacagtggtgaaaaactctgccagttgcttactcacaaagttagttttcttcactacctcatcaggtttgttatgtgagtgggcattaatctgggaagagtgggaccctgccagttagattagggctatcttggaggaatatgcggattcaatactgcaaatatttctgaaacaccttctgctttgtactctattagatacccaaagaaattttcatccttgaagcggaggaatttaatgatacctgaatgcctaactgttgtattctgcttatacagaatccaatctcaagatacttggggtgaagaatgatgattcacagaagggaagggacatcttacataaacaaataatcgcagatacttgctaaagtgtatcccccaatctgggaaatactgtaaaggtgtatattattattgatgtaccaaagaagacagaataaattcataagagaaagtttatattcagtttactactacctagggttagattttagtttgttgttttttcagatgcaaatctacatgcagccttgcctggtagaagccagaagtgttgacagtattgaggacagcactcacatactgtgggaaagaataatacttgattaggacttattatttaatgaaatgaaaattttacaaaacagaaa

SEQ ID NO: 35050 - DNA, 3236 bp, Homo sapiens; identical to SEQ ID NO: 35045

SEQ ID NO: 35051 - DNA, 781 bp, Homo sapiens
atacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaa

SEQ ID NO: 35052 - DNA, 686 bp, Homo sapiens
atctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaattttgaaggctggaaagtccaaagccaaggtgctggcaggtttggtgtctggtgagggcctgctctgtgcttccaagatgacgccttgttgctgcatcctctggagacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctag

SEQ ID NO: 35053 - DNA, 2836 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggaacatcagctttccaaaccagatgtggtatctcagttagaggaggcagaagatttctggccagtggagagaggaattcctcaagacaccattccagagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggagctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgt

SEQ ID NO: 35054 - DNA, 2740 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggactctgcccacttccaccagagacacattgagaaggaggaaactatggcctccaggcttccgacggcctggtcctgtgaaccagtgacctttgaagatgtaacactgggttttaccccggaagagtggggactgctggacctcaaacagaagtccctgtacagggaagtgatgctggagaactacaggaacctggtctcagtggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggagctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgt

SEQ ID NO: 35055 - DNA, 2535 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggagctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgt

SEQ ID NO: 35056 - DNA, 1849 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcagta

SEQ ID NO: 35057 - DNA, 1075 bp, Homo sapiens
tcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggtaaggctttcttttcataacttaaaatttgattgcagtactgcaaacaaaatctttctgaggaccaactaatatttgaataagcaattattgcaaaagtcaaaatgtaattgaggggcacattcaagtagtgattagctttgaaatggttagagtacaagacatttgatttgacttgtcttttatttgacagtgtttatgtagtaaaaatgtcatgtctctagaactcacagtcatcttgaccaaaaaaaaaaaaaa

SEQ ID NO: 35058 - DNA, 1585 bp, Homo sapiens
cctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttattt

SEQ ID NO: 35059 - DNA, 1631 bp, Homo sapiens
gccgtcagggccccagcagggcggctcggtcccctcccatgagccccgccctggtaggcggagccacgggcccggccagcacgtgtaagagttcgcggcgggtcgccgcagtcactcacctgagcgcgcacggtccgcgcgtcctccgctcgtgcgtcccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttattt

SEQ ID NO: 35060 - DNA, 2799 bp, Homo sapiens
gggaacttccgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaa

SEQ ID NO: 35061 - DNA, 3473 bp, Homo sapiens
gatatgatggttggctctgagacaccattgaagggaccctgctaggagggcgatggtggcaagaaggtgtgtcaccttgattgccagtggcctggcttgtgcctgagtcagtgctttccactgtgtaagggctctggtattggacattctatatcccctgctacccgaagaccagagttgcccaaacttgcgactgactttcaaacaggacccctcttcctttgttctttttttttcttttattctctcaaacattctcttatccattcctcttcctttgatgccttatgtgagtgtaacagtctgtaattatgaagcacatactttttgcattcccgatttttttactccttgcagttgtgagtggcaatagagttagccctcagcaaacatttgctatgtgagcaaatgagtaaagagataatgagaggtagatcaaatccagggttggttggtttgttttgttttgttttgttttgtttgagagagaatcgcttgaacccgggaggcagaggtggcagtgagatgagattgcgccattgcactccagcctgggtgacaagagtgaaattccgtcttaaaaaaaataaagaaaatttaaaaataccgggcgcggtggctcacgcctgtaatcccagctctcagggaggcaacaggtgggaggatagcttgagcccaggagttccagacctgcctgggcaatatagcgagaccctgttctccacaaaaaggaaaaaaaaaattaaaaaataaaagaaaataaaagactagtcccagttgccacatttcttctcactgttcctgggtactcactgaaatactagctcccatctttctgtattcaggaggtttttttgaattatctttgaaccttgaacttttgcttctgcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttc

SEQ ID NO: 35062 - DNA, 1441 bp, Homo sapiens
ctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggactggatacacgtctgtttaactacgcaaaaggtaatgctggcatggcttactgggaccctaagtgtggcgaagggactctgctccagtgaactggcgagtgtggaacctcctgacaccttctgaggacctcctgcctgccatgttgctgtggagctcgcactcctcaggcatcccctgatgttgagtgatacaaactctatcaccggaatcgatgctgctgcaatgacaagacttctttctggttttcagattctaaagtttaaaacaacgacaacaacaggagcgcttgaaagttacggtgcttctccctctccagtgtggactcgctgatgtttggaaagattggacttgctacagaaggtctttccacagtgatgacaccagtagggcttttccccggtgtggattctgtggtgtttattgaagttggagctgtggttgaaggctttcccacactccttacacttatatggcttctctccggtgtggagtctctggtgggagctgaggcccgcatgctgactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagc

SEQ ID NO: 35063 - DNA, 543 bp, Homo sapiens
aaaattaaaaaataaaagaaaataaaagactagtcccagttgccacatttcttctcactgttcctgggtactcactgaaatactagctcccatctttctgtattcaggaggtttttttgaattatctttgaaccttgaacttttgcttctgcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaag

SEQ ID NO: 35064 - DNA, 2817 bp, Homo sapiens
aaacgagggggaacttccgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaag

SEQ ID NO: 35065 - DNA, 999 bp, Homo sapiens
agtggtgcgatgtcggctcactgcaacctccgcctcctgggttcaagcgattctcctgtctcagcctccagagtagctgggattacaggcgtctgccaccacgcccgggtaatttttttgtatttttagtcgagacggggtttcgccatgttggccaggctggtctcgaactcctgacctcaggtgatccgcccgcctcggcctcctaaagtgctgggattacaggcgtgagcctccgcgcccggccgcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattc

SEQ ID NO: 35066 - DNA, 735 bp, Homo sapiens
ggaacttccgttctttgttctgtccccggtgtgtgggtctgtgacagggtccaacagggcctggtccgtgtccggtcccccaaatctgtcgtccctgcccccaggtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattc

SEQ ID NO: 35067 - DNA, 4994 bp, Homo sapiens
aagtggccgatgcccgtcgccagtgacaccgggacaacagctgcgggctctgtgcgagcggcccagcagcgcggagcctcagcggagtgagcgagcgcggggcagtagcggcctgcgattgtgagatggggactgagaacaaggaggtgattcccaaggaagaaatttctgaagaatctgagccacatgggtcattattagaaaaatttccaaaagtggtttaccaaggtcatgagtttggagcaggatgtgaagaagacatgttggagggacattcgagagagtccatggaagaggttatagagcagatgtctcctcaggagagagactttccatcagggttgatgatctttaagaaatcaccctcaagtgagaaagaccgggagaataatgagagtgagagaggctgcagtcccagcccaaatctggttacacatcagggagatacaacagagggagttagtgcatttgctacctctggccaaaacttcctagagattttagaatctaacaaaacacagagaagttctgtgggagaaaagcctcatacatgtaaagaatgtgggaaagcctttaatcagaactcacatctcatccagcatatgagagttcatagtggagaaaaaccctttgaatgtaaagaatgtggaaagacatttggaactaattcaagccttcgacggcacctgagaattcatgctggagaaaaaccctttgcttgtaatgaatgtggaaaggccttcattcagagttcacaccttattcaccatcatagaattcatactggagagagaccctataaatgtgaagaatgtggtaaagccttcagtcaaaattcagcccttattctacaccagagaatccatactggagagaaaccatatgaatgtaatgaatgtgggaagacctttagggttagttcacagcttattcagcatcagagaattcatactgaagaaagataccatgaatgcaatgagtgtggcaaagccttcaagcatagctcaggccttattagacaccagaaaattcatactggagaaaaaccatatctgtgtaatgaatgtgggaagggcttcgggcagagttctgagcttatccggcatcagagaattcatacaggggacaaaccctatgaatgtaatgaatgtgggaaaacttttggccagaactcagagattattagacatattagaattcatactggtgagaagccctatgtatgtaaggaatgtgggaaggccttcagggggaactcagaacttcttagacatgagagaattcacactggagagaaaccctatgaatgctttgagtgtggaaaggctttcaggcggacctctcaccttattgtccaccagagaattcatactggagagaaaccccatcaatgtaatgagtgtgcaagaaccttttgggataattctgagctgcttctccaccagaaaattcatattggagagaaaccttatgaatgtagcgagtgtgagaaaacatttagccagcattcccaacttatcatacatcagagaattcacactggagagaagccttatgagtgccaagaatgtcagaagacttttagtcggagctctcacctcctccgacatcaaagtgttcactgtatggagtaatctgcaaaataggaaagcttttagtggaaaagctaaagtccaacttattcatttgttcataatatgcaaatatgcaccccaagtattcaaatccaatgaatggacagaacctcctctgtcctcccactgattttaaatagttggttgaagaagatgaggcacttttttttttttttttttaagcattggggtcttgctctgttgcccaggatgggatgcagtggcacagtcgtaactcactgcttccttgaactcctgggctcaaacagtcctcctgcctcagccttccaaatagctaggactgcaggcactaatgaggcacttttatgaattattcattgagaggtttcagtgtgctaagttaaatcataaaagctctttcaggccttaatttcccctctgtccttccttccccttctcctcccccagtggatcacataacaaacattaagggtctgtaccagccatctttcctaaattactcttcagcaaaattgtgggaacaggattccaccacctcctaagaatgagagttgactcattgactgttaccccctgaaatattagaaagtcataatttagaagacacacctcattctcctgtccactgtttagcattggaataatttagtaagctgttattagcttcaaagtcgtccagccctgctatgaagttactttagaagatggcagcattaatgaagaagcaggctcatttcacatctgtcaggcttccttattcatctgaagaggctgccatgatggaggaactgacaggcaatttacaacgggattataagtgaaggccttagaatccagaggggccgattaggcaacaccaggggataaacaattgaggtcacactgctcggcatgggcagaagcagctcttcaggagctgtccacacttcaggggtgctcagactgactgctcctaagaattctgctgcatatatttttagccccatctcctgccactgctgacagatattgtgacagtaagtagcagacaggactgtggcttcacctcctccgggcacctggctacagtgatgagtcagttcacctgatgacaaaccagggtctggccttgccaaagcacttaagttctcatgacctggaccgcactggaggccctggctaagtcaggatgtcgtagcctcttcttggttttgccccttggccttgaaattcttttttcttgaataactttaaaaaaatagagataaagtcttgctatgttgcccaggctggtcttgaatgcctgggctccagcaatctttttgcctcaacttcccaaagtattgagattacaggtgtgagctaccatgcccggccttgaaattctttcttcgctatgtctgcatgttttttgtgttctgtatttatttcttctccaaggaaacagcctacattttccatgtgtccatgtttctgaggccgtgggtgacagtgggaattgcactaatgggggcccaacaggcctgggggctggtcttagcgctagaccttgaacaaggcacttcacctgctggtctccaattttctcctctgtaaaatgaaagagttgaactaagtgatctcaaaagtttcaaccagcccgataattccttaattctttaaaaatttaactttatatatctttattattctttaacctcatctttgttacactaatattagtcactaatatttattgagtgtttactacctgacaggcagagtgccagtttacattttaattttcacatcatttctatgatgtgggtactcatttttttaaagctttatgaaggtataatttacgtactataaaattcacctgttttaagtgttcagttgaatgatttttaatttacatagtggtgcaaccatcaatgatgtgggtattcttaccccaatttaaaagataagaaggggcagtgttaagtaattgacccatgattccacagctagtaagagcgacagccaagactccaaacctggttgatgctcttaaccactgtgctatgccgcaggtaggcagattcattactgccttatctgaaaccctttgcacagtttctattactgatttctatgtagatttgaatataacaaatttaaatcatgtccttggtaacagaactgatcacagccaaaaaaaattcaccaaatgggtttattctgtactccaatataggtgtcttcccaggtttatatccttggcttgagaaaagggttgtacaaatagatgattgcagagtttccacatccttccagatacctctgcctctagcagtcacactcttagtaagggaagttgtttgatttacttcttcccttaggttgattacaagtgaagtgcgccgtcttattcctttttcattgctggagcacaaattgaattgtgcccagaccgtatctttctcacatgaaacctggatctcacctatcccttccatgcctgattcccgtgtttgcatattttatttccacatttacctcttgtcagccctgacagagaatttggcaccccttcaagcttctcctaaacaatctatgcacacaaacacccctgagcaatatggacttcactgaagatagtgtgtaagcaaaggagaagagttcacattgtgcatcctattagacattttgttctcagaagtaccttactggccaaaccaatgaaggttttcctcttgtcctcccctctcaaggctcagtcacctcaacttctttttgcctactagatatccaatccatcacctcgcctcccctggccctagctcaattaccctcttaaacccattcctgctcagcaaaacttcctctagttcaccattcattcatttgaacattaggaggcaatttagtgacctgttgtacctgaccatgttcttaagggggaggtctcacgtctcattcccagaaaagtctaccatatatagatacatattccccgccccgccccagatttctggtgaatgaaatcacttgtatcttattaggtacatatacgcaaatccttaacctcaattctctgtcctcttcatgtcttacccagatatctcaggaagatttctcttttccttctgtttgcctccctcttcgacttacttgggagtcagcatctgaccacagtcgtgactggtaatgatgatttgtgcaaatactatcaaggaaaggacatgaattgtcttaattttagacccattaaaaaaccgcacaggcctcaatcttaaaagtcctatctaaatacccagaaatacccttcagaatttttgaagctatgcccatgtacaaaattttcttccttccctaattttaatggtatactaacaccttaggtaaataaaatatttctttactattttattg

SEQ ID NO: 35068 - DNA, 3268 bp, Homo sapiens
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctg

SEQ ID NO: 35069 - DNA, 3256 bp, Homo sapiens
gaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagggaagaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaa

SEQ ID NO: 35070 - DNA, 3226 bp, Homo sapiens
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctg

SEQ ID NO: 35071 - DNA, 3323 bp, Homo sapiens
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccaggtacaagaggagtaaagaatgatccctcctccacatggtgcctgctgagacttcttcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctg

SEQ ID NO: 35072 - DNA, 4417 bp, Homo sapiens
ttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 35073 - DNA, 4313 bp, Homo sapiens
tgaaggctgagttctagagatcgggtcggctttctacgcggctctcgtggaacctagcaaagaaagacagtgaagactgcaggaccttccttcgcgcttttgttacaatccacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 35074 - DNA, 3391 bp, Homo sapiens
atcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactagctttcattttcccagtcccatgcagttgcgcagttggagggggcagaaaaccttgggtgcctgacagggcagacatcactgcagccacagtaaaggagacctacagagggcatggccctgctgaatgggagctggaagagggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcga

SEQ ID NO: 35075 - DNA, 4074 bp, Homo sapiens
gagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgct

SEQ ID NO: 35076 - DNA, 3978 bp, Homo sapiens
gagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgct

SEQ ID NO: 35077 - DNA, 744 bp, Homo sapiens
attgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactgggtaaggccagtgccatttctccacttattcatccatgaattagatgtttttgtttgagtatgttctgtgacccaggaactatgcagcggttcagaacgcagctgtgaacaagcagccccagcacccatgcttaatggggcctctcctgggtatcgaggcccatctattgcagggaccatggtggttctccggtgtgtgtctgagcttggcatgggcttctgaaatacgaaatccccattcttttggagggtcagtgtgtgggtacttgtgatcttatttcctatttctttttttttttttttttttttatttttgg

SEQ ID NO: 35078 - DNA, 1137 bp, Homo sapiens
ctggcgctgctgcgggctcggcgccggcctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattatca

SEQ ID NO: 35079 - DNA, 1201 bp, Homo sapiens
gcggccgccaaggaaatgagcaggcctggccggcccgggccccgagggaggccagccgcgagcggagaggtcggcggtccgcagagcagggtcccgtggaccggagagcgggatgccgaggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattatc

SEQ ID NO: 35080 - DNA, 6038 bp, Homo sapiens
ctaacatttaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacagaccgatatgatcaaaggcatgctggaaacaagcctattaaaggtcagcttgaatcaagatttcatttgcatttgcgaagacataggagaattcatactggagagaaaccttacaaatgtgaagaatgtgagaaagttttcagttgcaaatcacatcttgaaatacataggataattcatactggagagaaaccatacaaatgtaaggtttgcgacaaggcttttaagcatgattcacacctggcaaaacatactagaattcacaggggagacaaacattacacatgtaatgaatgtggcaaggtttttgatcaaaaagcaacccttgcatgtcatcatagaagtcatactggagagaaaccttataagtgtaatgagtgtggcaagacctttagtcagacatcacaccttgtgtaccatcatagactgcatactggagagaaaccttacaaatgtaatgagtgtggcaagaccttcgctcgaaattcagtcctcgtaattcataaggcagttcatactgcagagaaaccctataagtgtaatgaatgtggcaaggtttttaagcaacgagcaactcttgcaggacatcgtagagttcacactggagagaaaccttacagatgtgaagaatgcgacaaagttttcagtcgcaaatcacatcttgaaagacataggaggattcatactggagagaaaccatacaaatgtaaggtttgtgacaaggctttccggagtgattcacgtcttgcagaacatcagagagttcatactggagagagaccttacacatgtaatgaatgtggcaaggtttttagtacaaaagcgtacctcgcatgtcatcaaaaacttcatactggagagaaactttacgaatgtgaagaatgtgacaaagtttacattcgcaaatcacaccttgaaagacataggaggattcatacaggagagaaacctcacaagtgtggtgattgtggtaaagcctttaattcaccttcacaccttattaggcatcagagaatccatactggacagaaatcttacaaatgtcatcagtgtggcaaggtctttagtctgaggtcactccttgcagaacatcagaaaattccttttggagacaattgtttcaagtgcaatgagtatagcaaaccatcaagcattaattgacatcagagtcaaatcagcattgacctgagtttgagttgacttaacattgatttcaagcattaatcgacattaaactgtttatgttaagaggattgggccaggcgtggtgtctcacacctgtaatcccagcactttgagaggccaagacaggtaggtcacttgaggtcatgaatttgagaccagcctggccaacagacgggagccacttttcccagcctgtatgttcttttatttatttatttatttttaagatggaatcttgctctgtcgcccacgttggagtgcagtgatgtgatctcggttcactgcaacattcacctcccaggttcatgcaattctcctgcctcagtctcctgagtagctgggactacaggtgcgtgccaccatgcccgggtaattttttgtatttttagtagagactgggtttcaccgtgttagctaggatggtctcgatcttctgtccttaaaatccacctgcctccacctgccaaagtgctgagattacaggcgtgagccaccacacctggcctgttttttgtttctttaacaaaaagttatagaaatttctctgggtattgtgttgaatctacatcacattcagttataatcatttagcaatattattccattcaatatggcttgtatctcttatttgcacatgtttttatcactttgatcaatgtttgtagatttgaaggtagaaacttctcaacttttttcatttattcctaagtatttcttactttaagttctttagcaaatgaaagtgtttttttaattttctttttaaattgtttattgttaatgtatggaaattcaactaatttttggtgctgttattctattcttcaaatccactgcatatgttttttagttccagttgcattttggttgactctttgtgattttctacacagaagatcatgtcatctacaaagaaatagttttacttctttctttctgatttggatgagtttgatttcttttgctatttcattgctctagctaggacagccagtattgattgaatagaaggggtgagagcattcttgcatcatgtgagatcctacaggaaaagcattccattttccctgactggttatttctgctgtggtcatttcatggatggtctttgtattgttgaggtaaatttccttctctttctattttgtttaggatttccatgatgactggatgttgaattttgtgaaatgctttttctccatgtattgagatgatgtggttttcatctttcattatgttcaagtggtatatcacattgatttgcttgactatgttgaaccattttgcatcccagaaataagtggcacttgcatatcaacaatcctttttataacctcttgaatacagttcgctagtacaaggggtcttcaggaagttcatggaaaaatacatattatgagaaaattgtgcatgatatcacattttttgcaccaagataaactgatacaaatccgttataacatgtctgaacagggtttggtttgaggcactcagatgggtaagacatgagtttgaaaagagactcaatcaaggcaatgtaaattctgctaaaactgaaacaagaagaaacatcaaatttgcgatgagaccagatgctgtggctcaggcctgtaatcccataattttcagaggctgagacagttgggtcacgtgggccccggtactcaagaccagcctgggcagaatggtgaaaccaccttctctacaaaaaatacataaattagctgggcattgtggcacatgtctgctggttcagcttctgtggagtctgcagtgggaggatggcttgagcctaggagttcgaggctgcagggagccatgatcatgccattgtactccagcatgggtgacagagacagatagtgtatcgaaaaatgaatctggtaaagtttgggtagagggacaatgaaatcattgatgctttatgaaaaggttatggggacgattcccaaaataaatcaccagtttgtaaatggaaaacttattttaagttgggacaagatgatgttgaaagtgatgcacaggacaggtgtggtggctcacacctgtaatcccagcactttgggaggccgaggcaagagcatcacgaggtcaggagatcgagaaaatcctggctaacacggtgaaaccccatctctactaaaaatacaaaaaattagccaggcgtggttgtgggcgcctgtagtcccagctactcaggaggctgaggcaggagaatggcatgaaccgaggaggtggagcttgccatgagcagagatcatgctactgcactccagcctgggtgacagagcgagactccatctcaaaaaaaaaaaaaaaaaaaaaaaaaagaaagtgatgcacagagtggcaggcagaccatccacataagttttataggtacaactgtcaaagacgacactggagaagagccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaagtcaaatgacttaattctgtattttaaattctgttttgtttgttttgtttttttgagatggagtcttctgaaaattttctcatcttctctaacccggttcatgacagacccttggactttactgttgtggaaaaatctatataaaacagtatcagtgtgtcaaagcattatggctgtcacaagcttgtgaaaggaaaataaaaattactaagccaaagagaaaagtcaatctgggaactgcgtcagacaaacctgccttccattttattcctaaacaagatagttacaaagattttttaaaaagctacatatgcccctcccaaaccgggaacctcaagatctccaccctaaaatagttctgttgaatttcaccctggcgatgtaaactgagagcttatcttcacagatgtgggaaagagcccatccctctgcacacctgagtcaaatgtctatctgattgcttcccttgccctatttatgtaaaaatacagggtccctgagccagcctaaggcataagtgacttatccctcctccctgctcacatataaattgtgtatttagtgaaaggctgatcaaagattcaaagaatgttatttgttatctacctgtgacccagaaggtccccaattccagttattccacctttccagaccggaccaatgtatatatgtactgattgctgtctcgtgtgtctgtaaaatgtgtgaaaccaaactgcagcctcaacaccatggacacacgtcatcaggacctcctgaggttcgtgttaattggccttagactctccctgtccccagacccaggacgcatgtgtttcctttttcttcatttctattaaagatgggtctcattctgttggccaggcatgagagcggtgacaggatcagccctcactgaagcttcaatctcctgggttcaagggatcctcccacctcagcctccaaagttgctaggaccatagccaggtgccaccgcaccgggcaaatttttgtgttcctagtagagatgggctttcaccatgttgcccgagctggtcttgaattccagggctcaagcgatccagccgtattggcctcccaaggtgctgggattacagccatgagccaccatgaccaacgtgtttcttaatttaaaaaaaaaaaaatagaccaggtgctctggctcatgcctgtaatcccagcactttgggaggccaaggtgggcagatcacctgagatcaagtatttgagaacagcctggctaacatggcgaatcctcgttttgaccaaaatatagaaattagcctggtgtggtggcgagtgcctgtaatcccagctattcaggagggtgaggcagaagaatggcttgaattcgggaggcggaggttgcagtgagctgagatcctgcaactgcactctggctgggcaagagcgagactccatctctaaaataaaattaaagtaatataaaaaactgcttctcatgaaagctttggtataatcttacgaggtaacatcattgttttgcaactacggtatgtgttcaaaatgttcttctttgaccccacatttcattagatatatttttaagccattttaaaattgtttttctctgaaatttattgtgtttagtttacattgaggactgcatgctttctagtctgtatcatacattggaaacattttctagtacctgataaatgattttaggttgtttcgatgtgtacttgataaagatatcaaggaactttttctttatgctaacattaaaatttagttgaagtagcctatta

SEQ ID NO: 35081 - DNA, 6448 bp, Homo sapiens
cggcccctctttctcaacccagagcaaattgagacgtccgggctggagtgcaatggcgcgatcttggctcaccacaacctccgcctcctgggttcaagtgatctcctgcctcagcctccccagtagccgggattacagtagagacaaggtttcaccatattggccagactgttctctgaactcgacctcaagtgatccacccacctcggcctcccagagtcctgggattacaggctggagggcagttgtgcgatcttgattcacttcaacctctgctctccgggctcaagcaattctcccacctcagcctgagtctcactctgtccttcaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctactgacattcagggatgtggccatagaattctctcaggaggagtggaaatgcctggaccctgctcagaggactctatacagagacgtgatgctggagaattataggaacctggtctccctggatatctcttccaaatgcatgatgaatacattgtcatcaacagggcaaggcaatacagaagtgatccacacagggacattgcagagacaagcaagttatcacattggagcattttgctcccaggaaattgagaaagacattcatgactttgtgtttcagtggcaagaagatgaaacaaatgaccatgaagcacccatgacagaaataaaaaagttgactagtagtacagaccgatatgatcaaaggcatgctggaaacaagcctattaaaggtcagcttgaatcaagatttcatttgcatttgcgaagacataggagaattcatactggagagaaaccttacaaatgtgaagaatgtgagaaagttttcagttgcaaatcacatcttgaaatacataggataattcatactggagagaaaccatacaaatgtaaggtttgcgacaaggcttttaagcatgattcacacctggcaaaacatactagaattcacaggggagacaaacattacacatgtaatgaatgtggcaaggtttttgatcaaaaagcaacccttgcatgtcatcatagaagtcatactggagagaaaccttataagtgtaatgagtgtggcaagacctttagtcagacatcacaccttgtgtaccatcatagactgcatactggagagaaaccttacaaatgtaatgagtgtggcaagaccttcgctcgaaattcagtcctcgtaattcataaggcagttcatactgcagagaaaccctataagtgtaatgaatgtggcaaggtttttaagcaacgagcaactcttgcaggacatcgtagagttcacactggagagaaaccttacagatgtgaagaatgcgacaaagttttcagtcgcaaatcacatcttgaaagacataggaggattcatactggagagaaaccatacaaatgtaaggtttgtgacaaggctttccggagtgattcacgtcttgcagaacatcagagagttcatactggagagagaccttacacatgtaatgaatgtggcaaggtttttagtacaaaagcgtacctcgcatgtcatcaaaaacttcatactggagagaaactttacgaatgtgaagaatgtgacaaagtttacattcgcaaatcacaccttgaaagacataggaggattcatacaggagagaaacctcacaagtgtggtgattgtggtaaagcctttaattcaccttcacaccttattaggcatcagagaatccatactggacagaaatcttacaaatgtcatcagtgtggcaaggtctttagtctgaggtcactccttgcagaacatcagaaaattccttttggagacaattgtttcaagtgcaatgagtatagcaaaccatcaagcattaattgacatcagagtcaaatcagcattgacctgagtttgagttgacttaacattgatttcaagcattaatcgacattaaactgtttatgttaagaggattgggccaggcgtggtgtctcacacctgtaatcccagcactttgagaggccaagacaggtaggtcacttgaggtcatgaatttgagaccagcctggccaacagacgggagccacttttcccagcctgtatgttcttttatttatttatttatttttaagatggaatcttgctctgtcgcccacgttggagtgcagtgatgtgatctcggttcactgcaacattcacctcccaggttcatgcaattctcctgcctcagtctcctgagtagctgggactacaggtgcgtgccaccatgcccgggtaattttttgtatttttagtagagactgggtttcaccgtgttagctaggatggtctcgatcttctgtccttaaaatccacctgcctccacctgccaaagtgctgagattacaggcgtgagccaccacacctggcctgttttttgtttctttaacaaaaagttatagaaatttctctgggtattgtgttgaatctacatcacattcagttataatcatttagcaatattattccattcaatatggcttgtatctcttatttgcacatgtttttatcactttgatcaatgtttgtagatttgaaggtagaaacttctcaacttttttcatttattcctaagtatttcttactttaagttctttagcaaatgaaagtgtttttttaattttctttttaaattgtttattgttaatgtatggaaattcaactaatttttggtgctgttattctattcttcaaatccactgcatatgttttttagttccagttgcattttggttgactctttgtgattttctacacagaagatcatgtcatctacaaagaaatagttttacttctttctttctgatttggatgagtttgatttcttttgctatttcattgctctagctaggacagccagtattgattgaatagaaggggtgagagcattcttgcatcatgtgagatcctacaggaaaagcattccattttccctgactggttatttctgctgtggtcatttcatggatggtctttgtattgttgaggtaaatttccttctctttctattttgtttaggatttccatgatgactggatgttgaattttgtgaaatgctttttctccatgtattgagatgatgtggttttcatctttcattatgttcaagtggtatatcacattgatttgcttgactatgttgaaccattttgcatcccagaaataagtggcacttgcatatcaacaatcctttttataacctcttgaatacagttcgctagtacaaggggtcttcaggaagttcatggaaaaatacatattatgagaaaattgtgcatgatatcacattttttgcaccaagataaactgatacaaatccgttataacatgtctgaacagggtttggtttgaggcactcagatgggtaagacatgagtttgaaaagagactcaatcaaggcaatgtaaattctgctaaaactgaaacaagaagaaacatcaaatttgcgatgagaccagatgctgtggctcaggcctgtaatcccataattttcagaggctgagacagttgggtcacgtgggccccggtactcaagaccagcctgggcagaatggtgaaaccaccttctctacaaaaaatacataaattagctgggcattgtggcacatgtctgctggttcagcttctgtggagtctgcagtgggaggatggcttgagcctaggagttcgaggctgcagggagccatgatcatgccattgtactccagcatgggtgacagagacagatagtgtatcgaaaaatgaatctggtaaagtttgggtagagggacaatgaaatcattgatgctttatgaaaaggttatggggacgattcccaaaataaatcaccagtttgtaaatggaaaacttattttaagttgggacaagatgatgttgaaagtgatgcacaggacaggtgtggtggctcacacctgtaatcccagcactttgggaggccgaggcaagagcatcacgaggtcaggagatcgagaaaatcctggctaacacggtgaaaccccatctctactaaaaatacaaaaaattagccaggcgtggttgtgggcgcctgtagtcccagctactcaggaggctgaggcaggagaatggcatgaaccgaggaggtggagcttgccatgagcagagatcatgctactgcactccagcctgggtgacagagcgagactccatctcaaaaaaaaaaaaaaaaaaaaaaaaaagaaagtgatgcacagagtggcaggcagaccatccacataagttttataggtacaactgtcaaagacgacactggagaagagccaagctggatctataaggaattgcatatgagatggcacacatattcatgctgtctgaagattcagtcacgttaccatatcaagctgaaaatgtcaccactatctggagagttggacatgttttattgagaatgtattttttttctctggatctgttatgaacacctttgttggcttggttcagtaataaatatgtgagacttttcatttaaaaaaagtcaaatgacttaattctgtattttaaattctgttttgtttgttttgtttttttgagatggagtcttctgaaaattttctcatcttctctaacccggttcatgacagacccttggactttactgttgtggaaaaatctatataaaacagtatcagtgtgtcaaagcattatggctgtcacaagcttgtgaaaggaaaataaaaattactaagccaaagagaaaagtcaatctgggaactgcgtcagacaaacctgccttccattttattcctaaacaagatagttacaaagattttttaaaaagctacatatgcccctcccaaaccgggaacctcaagatctccaccctaaaatagttctgttgaatttcaccctggcgatgtaaactgagagcttatcttcacagatgtgggaaagagcccatccctctgcacacctgagtcaaatgtctatctgattgcttcccttgccctatttatgtaaaaatacagggtccctgagccagcctaaggcataagtgacttatccctcctccctgctcacatataaattgtgtatttagtgaaaggctgatcaaagattcaaagaatgttatttgttatctacctgtgacccagaaggtccccaattccagttattccacctttccagaccggaccaatgtatatatgtactgattgctgtctcgtgtgtctgtaaaatgtgtgaaaccaaactgcagcctcaacaccatggacacacgtcatcaggacctcctgaggttcgtgttaattggccttagactctccctgtccccagacccaggacgcatgtgtttcctttttcttcatttctattaaagatgggtctcattctgttggccaggcatgagagcggtgacaggatcagccctcactgaagcttcaatctcctgggttcaagggatcctcccacctcagcctccaaagttgctaggaccatagccaggtgccaccgcaccgggcaaatttttgtgttcctagtagagatgggctttcaccatgttgcccgagctggtcttgaattccagggctcaagcgatccagccgtattggcctcccaaggtgctgggattacagccatgagccaccatgaccaacgtgtttcttaatttaaaaaaaaaaaaatagaccaggtgctctggctcatgcctgtaatcccagcactttgggaggccaaggtgggcagatcacctgagatcaagtatttgagaacagcctggctaacatggcgaatcctcgttttgaccaaaatatagaaattagcctggtgtggtggcgagtgcctgtaatcccagctattcaggagggtgaggcagaagaatggcttgaattcgggaggcggaggttgcagtgagctgagatcctgcaactgcactctggctgggcaagagcgagactccatctctaaaataaaattaaagtaatataaaaaactgcttctcatgaaagctttggtataatcttacgaggtaacatcattgttttgcaactacggtatgtgttcaaaatgttcttctttgaccccacatttcattagatatatttttaagccattttaaaattgtttttctctgaaatttattgtgtttagtttacattgaggactgcatgctttctagtctgtatcatacattggaaacattttctagtacctgataaatgattttaggttgtttcgatgtgtacttgataaagatatcaaggaactttttctttatgctaacattaaaatttagttgaagta

SEQ ID NO: 35082 - DNA, 2910 bp, Homo sapiens
gggggtggggctgcgccggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaacctta

SEQ ID NO: 35083 - DNA, 2675 bp, Homo sapiens
attcctcctgtttaactgaaattttgtatcctttgaccaatttcttcccaaccctgctatgtctcagcctctggtaaccaccattttaccatctgtttctatcagttagactgttttatactccatatcattatctctctattccagtattatgttgaaaagcagtgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaacctt

SEQ ID NO: 35084 - DNA, 587 bp, Homo sapiens
ccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaa

SEQ ID NO: 35085 - DNA, 2619 bp, Homo sapiens
acgcatttccggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaa

SEQ ID NO: 35086 - DNA, 3176 bp, Homo sapiens
cagagagagagagaaaaactgctgaccctgtaagagagaactggccatcttgcagacagacagagccccgagtgttctttcaactacctgccacccatccaacaactcccctcggacctcagtatgggctggaacctgacacttggcatgacagtgaccccaggcatccaaaccatgacagttccatcagctctccaaatgagagacagagtctcactatgtcgcccaggcttgtcttgaactcctggactcaagagatcctcccatctcggcctctcaaagtgttgggattacaggcgtgagctattacacctgacttaagtctccattttcatatctatactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccctaaa

SEQ ID NO: 35087 - DNA, 3551 bp, Homo sapiens
attgctgggcaactaggtcccgccggagcgttccagctcaaagattacctgctgcagtcaggcagaaatgtaaagtctttcctgtttgattgggaactgacccaggtgccaggcttggggggacaccggacaaccaaaggcaatatgtggactcggcaagccactggtccctaaacctgaataagtttccgggcagagctgcatttattgacggttatgaaagctgatttagaagcagcaacgcagcctcttgcctggaattgggatgatgcggctgaaaccaccttcctggcagccaaacaggctattcagcaggcacaagccctatgggtagctgatcggggcacccatttaaacttgatgtgcatgtgaccagatagttttgactggggcttatggcatcacacagagctctttagaatgccagtagacttttggtcccaactttggaagggagctgagctccagtattcctcgacagagaagcagttactaactgcatatgctgccctttagactcgtgacagcctggcaggatgggctacagtcgtcgcgcgcatgacttacccaatagcaggccccgagtgttctttcaactacctgccacccatccaacaactcccctcggacctcagtatgggctggaacctgacacttggcatgacagtgcagaccccaggcatccaaaccatgacagttccatcagctctccaaatgagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccct

SEQ ID NO: 35088 - DNA, 575 bp, Homo sapiens
aatgagactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtgg

SEQ ID NO: 35089 - DNA, 584 bp, Homo sapiens
acttgtgcccagagagagagagaaaaactgctgaccctgtaagagagaactggccatcttgcagacagacagagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatc

SEQ ID NO: 35090 - DNA, 3050 bp, Homo sapiens
attggggtgctgcagccccgccacctgttccgtagcttgccggtgccccgaaggtgagtcttggccccttgtcgcgacccgccaggttcccagaagatttcaggtctgtgccttggagtaggcggggagggaacgtctgcgcaggcgtgacccccgcccctacacattcactggcctgaagcccccgtggagtaggtggaggtcccgccccttatcctgaagattaaacagcctttctttgtctgagataacgcccggagttctttgtcctgcctccaagacgataaaggagcgcagacacaaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccctaaa

SEQ ID NO: 35091 - DNA, 580 bp, Homo sapiens
acttgtgcccagagagagagagaaaaactgctgaccctgtaagagagaactggccatcttgcagacagacagaggtgagccaggaattaacaagcatgccaaggagtacagctgtaagtgtgggagcggcaggagccacagagccgtttgctgagaagggctgcggtcggaggaggcagccgagacagaggcagacagtgtgagagctgcagcagctgctgctgaataaaatcatattttacctgcctacagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaag

SEQ ID NO: 35092 - DNA, 583 bp, Homo sapiens
aaaaggagaagaaacttttcctgggaacctgctgactatacaaaggacaaaggcattatgtgtcaggccttgttcccttatctgaccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacataca

SEQ ID NO: 35093 - DNA, 557 bp, Homo sapiens
agagccgtttgctgagaagggctgcggtcggaggaggcagccgagacagaggcagacagtgtgagagctgcagcagctgctgctgaataaaatcatattttacctgcctacagccccgagtgttctttcaactacctgccacccatccaacaactcccctcggacctcagtatgggctggaacctgacacttggcatgacagtgagacagagtctcactatgtcgcccaggcttgtcttgaactcctggactcaagagatcctcccatctcggcctctcaaagtgttgggattacaggcactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaa

SEQ ID NO: 35094 - DNA, 706 bp, Homo sapiens
agagaaaaactgctgaccctgtaagagagaactggccatcttgcagacagacagagccccgagtgttctttcaactacctgccacccatccaacaactcccctcggacctcagtatgggctggaacctgacacttggcatgacagtgactttgggattccagaagacagaggtttgagtgtaaaacacaaaataacaaaaccacaacaaaaacaactctgtattctcgtccccaccattaccatctctcctttgtgatgtcaaagagaccagaggaagtggacagactcggggaagaataggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatc

SEQ ID NO: 35095 - DNA, 581 bp, Homo sapiens
gaggtcccgccccttatcctgaagattaaacagcctttctttgtctgagataacgcccggagttctttgtcctgcctccaagacgataaaggagcgcagacacaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggt

SEQ ID NO: 35096 - DNA, 799 bp, Homo sapiens
gcctggcttcagccagtgggctcagaacggctgacgcatttccggcctttgcggttgatcggtcattggggtgctgcagccccgccacctgttccgtagcttgccggtgccccgaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacaga

SEQ ID NO: 35097 - DNA, 1899 bp, Homo sapiens
aaggcgctgctgtcgtaaaaggacgtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaa

SEQ ID NO: 35098 - DNA, 1180 bp, Homo sapiens
ggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagagggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaacacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcag

SEQ ID NO: 35099 - DNA, 573 bp, Homo sapiens
gtccggaatcggctgtcagcctccctggctgttagtaccttctttcccggagtcctggtccacgagttggatttactgctgtcgcgggtgggcctcacgccattccctgtccctcggccccctgagtgagtccggtctcccggcgaaagggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatgg

SEQ ID NO: 35100 - DNA, 552 bp, Homo sapiens
gtccggaatcggctgtcagcctccctggctgttagtaccttctttcccggagtcctggtccacgagttggatttactgctgtcgcgggggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctc

SEQ ID NO: 35101 - DNA, 838 bp, Homo sapiens
gtccggtccgtctcctagtgtccggaatcggctgtcagcctccctggctgttagtaccttctttcccggagtcctggtccacgagttggatttactgctgtcgcgggtgggcctcacgccattccctgtccctcggccccctgagggaaaatgcctaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcagaggcggcagaagaatagagcattttgctacttttgtaattctgtacagaagttaccaatttgtgcacagtgtgggaaaacaaagtgcatgatgaagtcttcagactgtgtcataaagcatgctggtgtatacagtactggccttgcaatggtgggtgcaatatgtgacttctgtgaagcttgggtttgccatggtaggaaatgtctcagtacacatgcttgtgcctgccctcttaccgatgctgagtgtgttgaatgtgaacgaggcgtgtgggaccatggaggcagaatattcagttgttctttttgccataactttctctgtgaagatgatcaatttgagcatcaagccagctgccaggttttagaggcagaaacatttaaatgtgtttcatgcaatcggcttggtcagcactcatgtctccgttgtaaggcttgtttctgtgatgatcatacaaggagcaaagtgtttaagcaagaaaaaggaaaacagcctccttgtcctaaatgtgggcatgaaactcaggagactaaggaccttagcatgtcaa

SEQ ID NO: 35102 - DNA, 5042 bp, Homo sapiens
ggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 35103 - DNA, 2248 bp, Homo sapiens
gcggccgctgggtgcgcgtgcgcatgcgcgctggcctccagggggtggcgggaccgagtgtgtgacgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 35104 - DNA, 3817 bp, Homo sapiens
gttttaccagtgaggaaactttaccacactgtgaactctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 35105 - DNA, 670 bp, Homo sapiens
gtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatg

SEQ ID NO: 35106 - DNA, 573 bp, Homo sapiens
ggtgatcgggccttctgggtgacgcaggtgtgtgtgacagcacaacctgtagttccagcgtctctgtgctgagatgggtgatcgggccttctgggtgacgcaggtgtgtgtgacaacacaacctgtagctccagcttctctgtgctgggatggatgatcgggccttctgggtgacgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtga

SEQ ID NO: 35107 - DNA, 641 bp, Homo sapiens
gctgagatgggtgatcgggccttctgggtgacgcaggtgtgtgtgacaacacaacctgtagctccagcttctctgtgctgggatggatgatcgggccttctgggtgacgcaggtgtgtgtgacagcacaacctgtagctccagcgtctctgctgcttcccctgccttcacctcctaaccaagcggtacctgcctgagaacaagggccgcggaaggacgggagtgcctgagccctgccaggaaattcaccaacaagaaggcagaaacagccatgaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataaggg

SEQ ID NO: 35108 - DNA, 688 bp, Homo sapiens
agcggtacctgcctgagaacaagggccgcggaaggacgggagtgcctgagccctgccaggaaattcaccaacaagaaggcagaaacagccatgaggtgacgctttcagagctagaagtgctctccactcagggcgcctgagtgacaggagacggtggcctcaggagtagaattcctcctgtagagggacacgtccctgatgtgggagacagggagaggggcagctccacgcttcatcatctcagttaccacagcgtgctcttcaggaatctcccagaaactccatctcggggcctcgtatttctcattggttttattaggtatggcaggtgttacccttctggttctgttttccccaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaa

SEQ ID NO: 35109 - DNA, 761 bp, Homo sapiens
ggggcgacggaacccgcacctgtgaacctcggcagtgcgtccccgggactctgttctgtgaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatc

SEQ ID NO: 35110 - DNA, 670 bp, Homo sapiens
agtccgcgcaggtgagattggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaagg

SEQ ID NO: 35111 - DNA, 562 bp, Homo sapiens
ggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttg

SEQ ID NO: 35112 - DNA, 2120 bp, Homo sapiens
acgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 35113 - DNA, 540 bp, Homo sapiens
gtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatc

SEQ ID NO: 35114 - DNA, 2180 bp, Homo sapiens
atcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaa

SEQ ID NO: 35115 - DNA, 2130 bp, Homo sapiens
gactgtgtgacgcacttgcgtgggagtgcgaggctgacgcggcggctctatctcccgtaactgtgacacgggtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaa

SEQ ID NO: 35116 - DNA, 739 bp, Homo sapiens
ggggcgacggaacccgcacctgtgaacctcggcagtgcgtccccgggactctgttctgtgaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatcca

SEQ ID NO: 35117 - DNA, 1890 bp, Homo sapiens
aggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaa

SEQ ID NO: 35118 - DNA, 913 bp, Homo sapiens
gtcattgggggtgatgggggccgtgctcggtgcgcttctgcaccggtgacgcaaccgctgtgtctccgccagtccgcgcaggtgagattggcgcccatggctccaaggggagacgggcacggagcttctagcggtgacgcacttgctggagagggtgtggggtgacgcagccgggctctccccataactagggctggggtgctcccgaggctttggggcgacggaacccgcacctgtgaacctcggcagtgcgtccccgggactctgttctgtgaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggc

SEQ ID NO: 35119 - DNA, 574 bp, Homo sapiens
ttcccccgacggccccgcgtcctcttctagcctcaccctctcccgaggccccagcgttgggggactaccgggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgt

SEQ ID NO: 35120 - DNA, 4660 bp, Homo sapiens
gcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgagtcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaacaaattgttacttttattcttataaagtgatcatccttttccctattactgaacattcaaccattcattgtaatgatagtaaatacttatttagagtttactattaatagatagtagccactgcctgaagctttgcatcttttaatttagtcctcacactgacactttgaggtatgtactgttatccccaattcccagatgaggaagctgaggcccagcaagttaaggtgggctatcaaagtcatctgggtggcatgtgacaggcctgactctctctacagtggcagacccaggggactagtctccatttttacttgttctttttttttttttttttttttttttggttttaaagttctcttaggtataacttacataaacgttaataaatcttagggtacaccttggtgaattttgtatatgtctatacccaccacggtctccatcaaaatattttatcgtcccagaaatttcccttgggccccacctcatcctcaaaggttatcactattctgatgtctatcaccatagatttgtttttcctgttcatgtaaatggaaccataaacagccctcttgtgtctgttttcttcacttaatatagtgtcattgagatttatctatgttgtattatcagtagtttatgctttttaattgctgtgtaatagtccatagtctgaatataccacaatttaaaaattctattctgtttacaaacatttgagttctgtcctccaggttcatccatgttatcacaaatgacagaatttccttcctcatcaaggctgaatagtattccattgtgtagatataccacattttctttatccattcatccaccgatggacagttaggttgattccatatcttggctattgtgaataatcctgcaggttttattgttatgaataaagctgctgtgaatgttcttgttaag

SEQ ID NO: 35121 - DNA, 1151 bp, Homo sapiens
acttttgccccgggacctaagccccacccctatccctgtctctcggacataggctccgcccccagcaccaccctccatgctctgtgggaccccactccagagcctaacctcatcccccggggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgctgcctctcctgtccctgctgctgccatcctgcccagagccaccgttagttctcctggactccagttctgctcctgacaggcacctgggctccaccctggacacagaggccagagggatcccttagaagtgcaagtcaggtcagacgtgtttcctgagcgagcagctgccagcagagaagagaccacatcctactccaaggagaggtcttcctcccagaaaaactcactgactgcctgctccgcattcacgcaggtccacctccaaactccatcttccctccacccctcaacctcctggccatccactccccacttttttcccagcttttccctgacttctggagcctccttggagggtgccaccttccccagcccctgcctgggtgccctctctccaggccattttggatcacagtgattagctttgtatttaaggattgggtaaatcctgacaaggtaaatgggtctctctcttcttttattaatatgttccccaaagcaggatcaaatatgcacgttcatttggggtgagcaggtgtgagtggccccctcagcttcttgactct

SEQ ID NO: 35122 - DNA, 2784 bp, Homo sapiens
agagcctaacctcatcccccggggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggtggaccccatgtgaagaaaggagagagggagggagaatgagcaacgagggcccggtgccctctttgtttctgtgggctctctcctttcagtacagggctccagtgccctccacagaactccacacccagcccagcaagcccctccataatgggtgctgagagtggcaggcatggggctcttgttacatcagagccccaggaaacaggcggtcacagactattctgagtgggcagaggaggtccacctatggacacacgtttagagaagctgaggagttcatccctgaagacatccagcccgtgagtagtagaggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagt

SEQ ID NO: 35123 - DNA, 3594 bp, Homo sapiens
cggccgacggcggctgagctgtgctgcgcggcgcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaagggccacccaactaatttggaagaatttccacatccagtactctcttgcatgttcagatcgctagaatccaacctctggatatcaaaggatcactactggggcttgaagactccaaatctgcagattctgaagcttgcaggtcagtggccttggactttcaaacttccagttccgtgacatccgggctccttaacttccggcttccgggagcttagtcacatacttctggcttccggattgtaggttccccgcaaggagactaaggcctgtgtgggtctttgtttccccagccgtgcaatgactgttagatgcagaaagggggaaaacagccagggaaactgctcacagtggacccccacggtggagagctggagggagagggttcttcaaacgtgtaccctagctcctttgtctgctgtctttggtgggcgtggtcttgtacttaaaatccagctgagaagccaaactctaccttaaagccgtatttcatgtttcaaactggatgatataattctggagaaatgagatgggaaactctgctgcctacttgccccttaactcttgtttatctttgggtttcttactacataccagagcttaatctttattttcttacttaatattcaaacacaacccatgagcaaattaacattatttccatcataaataaagagaatggacttaataaatttaaaaagtgaagatatgggggcaaatggatgctgccatcagctgaccctagagtttcctctgaccttccttccccaacctcgtctgtgtttcacttctgccatgtccttaaaggggctgtgtgtcccccagaccacagagtccattgcactgcacctttccttcctcctcattttccatcttacaaatcatcaatattcctggatgtaggatcatgtctgtcttatatgttttagtttctctcaatttagcattatgccttgcacgagagtataggaatacctcatttcattgcccttcacagatattgcattttttacaaattgaacgtttatggcagccctgtgtcgagcaagtctgtaggtgccattttcccaacagcatgtgctcactttgtgtccctgcttgagcattttttaggaataaactatttttaaattaaagtatgtacattaaaaaaaagacataatgctattgcacacattacagtatagggtaagcatacttttatgcacactgggaaaccaaaaaatgtgtatgacttgctttattgcaatattcacattattgtggtgatctggagtggagcctgcaatatctctgaggtgtgtctgtatgtgctcatcacatatgtgatgaatggatgaataaattagtgtagagtgaagtgcttccatgaacctgaacatcatggtctggaaactatgggcagtgagtcaaatctgacccaccatctgtttctgtacagctaagaatagtttttacatttttcaaatgggtgaaaacaaataaaaagaagaatgatattttgtgtcacatgactgatatatgaagttcaagctcagtgtccataaagttttattaaaacatagccatgatcattcatttatgattgtctatagctgttttcatatcacaatggaagttcaagttcagtgtctgtaaagttttattaaaacatagccatgatcattcatttatgattgtctatagctgttttcataccacagtggtagaattgagttgctgtaaatacctggctcacaaagcctaacatatacactatcaggctctttaagaaaacatttggcgacccctgctctaggtagactctatggggatatgggctctacactcatagggacccacatgttccaagcctccagctgtgtgttctgcttcctcaagcagcagctgactctgatattccccatctcaccttagcagtctatatcaagcaaagggcacgcagaatcccatgcacccatcatgtatgtaataaaaggcagatattatgtggtctcttgaaccagccttaggcatggaggttgaggatcaggagtgacttgagggtactgactggcagagcaggagccccgttattttggacaaacaccgccactttaagtttcagcttcatttttagccttctggatttaaggaaattacttttttaaaaactataagcagccaaaaaaagcagacagtaaaatgcagataaaacagctcgggcacagaggaaggtggaggaaaagtctcttgggtaactgccaaacttcaccctcatacaatgggccccagtaaaacagtgggccttaataagcacattcctttccctccaggtgcactaaaatagggaagctaaaagcagacttggggggtatgcctacagctgcagaaaaatgtataaaagcaaacacaccactctccctcccatataagcacaacaaaaaaaacacagaagcagtccaagcctctaagaaactctcccaccctaaatccttaaacactcttagtctgtagaaaagactctaacctaattcagccagcagcccctctcaggtgtgttttctctaaaataaacctgtcttaaccatcaagcc

SEQ ID NO: 35124 - DNA, 3660 bp, Homo sapiens
cgcagcggaggaaagaggatggcgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctagccgtgtccgccgacagcagcgacgccgcggccgccccggggcaggcagaggcattgatgacctggaggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagctt

SEQ ID NO: 35125 - DNA, 4430 bp, Homo sapiens
cgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggaggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagctta

SEQ ID NO: 35126 - DNA, 3881 bp, Homo sapiens
cgcagcggaggaaagaggatggcgacctcgtcgatgccggagtcagagaggaacgtggctacgaaagcctcgggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggaggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagctt

SEQ ID NO: 35127 - DNA, 1336 bp, Homo sapiens
gaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagagatggggtttcaccatgttcctgctggtcttaaactcctgagttcaagtgatccacctgccttggcctcccaaagtggtaggattacaggcatgagccacagcatcccacctgtaatggggagttttaaatttacaacttcaatctttacttgtgtaggtcttttcagatttttctttttctacttgagttggttttagttgtttttgttttatggattttcccattttgttgaagttaaataatttgttggcatacattgttcataccattctttgtaattatttttatttctgtaagagtactagtaatacatctttaatccctacttttagtaatttgaaccttctctctcttttttttctttttcaatgtcagtctagctagaggtttgtatattttgttgatcttttccaggaatcagctattgtttttctgttctctagttcattaatttttactctataatctttctgctttcctgccttctgcttgatttggttttgtattgctgctcctgtccaagtgttttaaggtggaaaattagtttactgatttgagatctttttaaatatggttattacagctacaaatctctaaggattgctttatctgtgttccataagtttgagtatgtcttcatttttatctcaaagcattttttctaattttccttcttattgcttctttaacttttttttttaacttcggaatatgttatataatttgtgcatgtttgtgcattctaaaaattcctttgtcttactgatttgtaatttcgactgtggtcagagaatcattttaaatttattctggggaatgtttcatgtgtacttttgaagcatacctgctccactgttcgagtggaatgttctgtctatatctcttagatctggttgctttagagtgtcatctatatcttctgtttccatgtttatattgtgcccagttgtcctaaccattattgaaaatggggtattacagtttgcaataagtattgtagacttgtatatttttttcttttaattctgtcagtttttgctacacatactttgaggctctgttagtagtacataggcttagaattgttatgtctcctttattgattgacccttttattgttatattaataaaattcccctctttatccttagt

SEQ ID NO: 35128 - DNA, 2003 bp, Homo sapiens
tccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgcccctgagatgctcatgcccttggattaaacccctgcagtgctggaagaagaggactctgcactgcctgccacaccaggactggaagatccatggccttcccttcttccaaactaccttcccacaagatggggatggtggtcacatctccaacactagcatgctgtggaagagacatcagcattcttgcaacaaatctggaaacagcctaaagagacatttctacttcaaagagttgcactgaggaagtgcactggcactgctggggactcacctggggcccagggctgaggcttctcgtgtccttggagctgctgtcctcccgaggagtgtccacactgcagccagctcagcctcaggtgtcttctctggttttgaaaccaaatctaagtgggaaaagaagattcaagttttatccgatttagtctacataattttaagtatctatttgagctcaataccaagaatcacttccttctctctcccatctgtgatctccagaggaaaggtccccgggctaggagacactggctggcatcctaaagccagagctggccaaagggtgtgtgtccactcttccttcacctcttccccaccccacacttgtttttgtctcacgctcacttgctctttctgcctccctctcactctttaggtctcacaaaggctttggccaaagactgactgactttccttggctctctgtcatctccccatagtcaaaagcatttcataacacacaatccatgtgaagggacctctgatgaaaatccatttaaagaggagctcactaattatcaatacttactgctgagcctggaatcattcatatatacctcagagttcattcattccagatgcaatactagataaggagactcctatgaaccaaatatctaactctgaatagatagtgactgtcataatcaaaccctgtggctgcctcctccttactggagggtgtagaggaatgcagttttttgtttgtttatttgtttgttctgagattgcatcactgcactccagcctgggtgatagagtgagactctgtctcaaaacaaaacagtagaaaagaaacaaaaaccatgtgatgagaaacgggactttatggcagcactgacctcactgtcctcaatatgacctattaaagaacaagcattctgagcattctgtaatattggttccaggtatcaattacaacctatcatgatcatggtgaccctattacctatattctctagagcatgcaaatatgatttaattttctcctaccaggaaaaaggcccaatttcacttccttcccccatcaatgaatacaccagaccacatgttccatgattggtaaaaggcagagataggggtcttactttcagttcattcttaacatggtgtaattggagactgcttagcccagcttgtcttttttctttgaccccaaggaaatgaaacaaaaatacaagcccacctgtatcct

SEQ ID NO: 35129 - DNA, 2433 bp, Homo sapiens
atgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaa

SEQ ID NO: 35130 - DNA, 6117 bp, Homo sapiens
tgcctcgtccgccggctacgtctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaaccaaccctgagg

SEQ ID NO: 35131 - DNA, 2854 bp, Homo sapiens
cgtccgccggctacgtctgcgtttccgcctttccttttgtttttctcaggttttgcgtgggaggcggtcccgggatttcaagggtctacgcgcttttctatggcgaatgcaacccgacgagggagtggggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatag

SEQ ID NO: 35132 - DNA, 6084 bp, Homo sapiens
tctgcgtttccgcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagtctggacagctgatcacctgaaagagaggagccaagaaaaccaatctaaacatttgtgggaagttgtattcatcaataatgaaatgctgactaaggaacaaggtgatgtaataggaataccatttaatgtggatgtaagttcttttccttccagaaaaatgttctgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgtgaaaaagctttctgggataagtcaaacctcactaaacatcaaagatcacacacaggggagaaaccttttgaatgcaatgaatgtgggaaagcctttagccataagtcagccctcacattacaccagagaacacatacaggggagaaaccctatcaatgtaatgcgtgtgggaaaactttttgccagaaatctgacctcactaaacatcagagaacacacacagggctgaaaccctatgaatgttatgaatgtggaaaatccttccgtgtgacttcgcaccttaaagtacaccagagaactcacacaggtgagaaaccttttgaatgtcttgagtgtgggaaatcctttagtgaaaagtcaaatcttacacagcatcagagaattcacataggagataaatcttatgaatgtaatgcatgtgggaaaactttctaccacaagtcattactcaccaggcatcagataattcatacagggtggaaaccttatgaatgttatgaatgtgggaaaaccttctgcttgaagtcagacctcacagtacatcagagaacacacacagggcagaaaccctttgcatgtcccgaatgtgggaaattctttagccataagtcaaccctctctcaacattatagaacacacacaggggagaaaccctacgaatgtcatgaatgtggaaaaatcttttacaataaatcatacctaactaaacataatagaacacatacaggggagaaaccctatgaatgtaatgaatgtggaaaagccttctaccagaagtcacaactcactcagcatcagagaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattcccatgtacacttcaccaaacttcctctaaggataatgtataatcatagtatatggtcaagtccaagaaatcgatgttaccttgctggtagatagagacttagtcagattttactatggtttgcatgcactctgtgtgtgtgtgtacgtgtatgtgtgtgtgtgtggttatatcaaacttttacgacttttacatttgagtaaccatcaacacgattagtttacagaactgaaaaggaatctgagatctgtactgtatcaggattacaaaggatttagcctcaagtagttccctttttgtattaataaccacacgctttctgcaaccctatcccttgcatccacttgactatgaagtttttttaaagcacagataaattgaataatcagggcaatagcattaagcacatctgcgaattatccctgaagttcaaaagacttatatatgtataagtggtatgtgatataaatcgtgtgtttcatatgcataatggaatttaacgtaattgtgaataggaagtaggtatcctagtttagtagtggttacattatcaggcccatcccagatgtttgtgatgtcctgaaacaatttaaaaggagacccacagagctaatgtttatccatttaaaaggtataaatcaaaataacaaattatctaaaaaaaatctatcctgtacatgtgaagatctaggctcgcctccatgttactccctttctcttcctacctgtggctcatgccatgccatgaagtgcctagggtacatatgtgaacattccagccttcagcataagtggtagtccaaattttctttaagcagctgctctccaagacagggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagatacttaaggtagaaatgataccaagtctctaccatctctttcagaaaataaaagcagagataacacttcccaactcattttgtgaggccagtattaccctaatagcaaaaccaggcaaagatattacaagaaaggaaaactacagatcaatatttccattgaacacagatgcagaaatcctcaaaatattagcaaatcaggaatgcaaggcttgttcaacatttgatattcagtgtaatccattgcatgcattagcagctcaaagatgaaatacgatcatatcaataggtacagaaaaagcatttgacaaaatccaatatccattcatgttaaaacctctcaacacagaaggaatacaggagaacttactcaagttggtaaagaacatactacaaaaaaccctacagctaacattatccttgatgtttccaactagacactttcctactaagatcaggaacatggcaaggaacaccacaccactgcttttcagcattgtactggaagtgctatataatgcagtgttaaaaaaaaaagaaataaaatgcacatagatttgaaaggatgaaatacaactttgttcacaagtaacatgattgtctttgtagagaattctaaataacaaaaaccctgctgacattaataagcaattacagcaggattgcaggatacagtcctcaggtagatgataaaaaggaattggacatcaagtcattaaaagacacggagaaaccctaaatgcttattgttaagtgaaaaccaatctgaaaaggctttctattttgtatgattgcaattatatgacattttgggagaggcaaaactattgagccagtgaaaggaccagtggttgctgagagttgaggggaaaggagggatggcaggtagagaggtgatttttaaggcagtgaaagtactctctagggtactgtaatttgtcaaaacgcagagaatggaaaacagtgaacggaaaacacagagtaaaccctaatgtcaactctggacttcagttaataataatgtatcactgttggctcattaattgtaacaaatgaaccataatgatgcaagatgttaatgattggggagcctgtggaagatgggaggggaaagggttatatgagaattctctatactttttgctcaactttctgtaaccctaaagctactctaaaaaatgaagtgtatcaagtaaataaataaccaaccaacc

SEQ ID NO: 35133 - DNA, 2011 bp, Homo sapiens
gcctttccttttgtttttctcaggttttgcgtgggaggcggtcccgggatttcaagggtctacgcgcttttctatggcgaatgcaacccgacgagggagtgggctgtatcttcagagttgtctccgtctttccaagaacagaacaaaatgaacaaggtagaacagaagtcccaggagtcagtatcatttaaagatgtgactgtgggcttcacccaggaggagtggcagcacctggaccctagtcagagggctctgtatagagatgtgatgctggagaactacagcaaccttgtctcagtggggtattgtgttcacaaaccagaggtgatcttcaggctgcaacaaggagaagagccatggaaacaggaggaagaattcccaagccaaagctttccagaagtctggacagctgatcacctgaaagagaggagccaagaaaaccaatctaaacatttgtgggaagttgtattcatcaataatgaaatgctgactaaggaacaaggtgatgtaataggaataccatttaatgtggatgcccctgagatgctcatgcccttggattaaacccctgcagtgctggaagaagaggactctgcactgcctgccacaccaggactggaagatccatggccttcccttcttccaaactaccttcccacaagatggggatggtggtcacatctccaacactagcatgctgtggaagagacatcagcattcttgcaacaaatctggaaacagcctaaagagacatttctacttcaaagagttgcactgaggaagtgcactggcactgctggggactcacctggggcccagggctgaggcttctcgtgtccttggagctgctgtcctcccgaggagtgtccacactgcagccagctcagcctcaggtgtcttctctggttttgaaaccaaatctaagtgggaaaagaagattcaagttttatccgatttagtctacataattttaagtatctatttgagctcaataccaagaatcacttccttctctctcccatctgtgatctccagaggaaaggtccccgggctaggagacactggctggcatcctaaagccagagctggccaaagggtgtgtgtccactcttccttcacctcttccccaccccacacttgtttttgtctcacgctcacttgctctttctgcctccctctcactctttaggtctcacaaaggctttggccaaagactgactgactttccttggctctctgtcatctccccatagtcaaaagcatttcataacacacaatccatgtgaagggacctctgatgaaaatccatttaaagaggagctcactaattatcaatacttactgctgagcctggaatcattcatatatacctcagagttcattcattccagatgcaatactagataaggagactcctatgaaccaaatatctaactctgaatagatagtgactgtcataatcaaaccctgtggctgcctcctccttactggagggtgtagaggaatgcagttttttgtttgtttatttgtttgttttgagattgcatcactgcactccagcctgggtgatagagtgagactctgtctcaaaacaaaacagtagaaaagaaacaaaaaccatgtgatgagaaacgggactttatggcagcactgacctcactgtcctcaatatgacctattaaagaacaagcattctgagcattctgtaatattggttccaggtatcaattacaacctatcatgatcatggtgaccctattacctatattctctagagcatgcaaatatgatttaattttctcctaccaggaaaaaggcccaatttcacttccttcccccatcaatgaatacaccagaccacatgttccatgattggtaaaaggcagagataggggtcttactttcagttcattcttaacatggtgtaattggagactgcttagcccagcttgtcttttttctttgaccccaaggaaatgaaacaaaaatacaagcccacctgtatcctaga

SEQ ID NO: 35134 - DNA, 5945 bp, Homo sapiens
gcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggtattgtgctcacaaaccagaggtgatcttcaggctggaacaaggagaagaaccatggagactggaggaagaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcacgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaagggcctgttgacatcctgaatgttcaataactatccacaaactcgccttatgttactccaaagtaacagtaggggataaacccatagactacaacaactataggatggcttttgttaggaagtgatattctgttgaatatcagatggttaatactggcataaaacctcacagatttttttgaatttgtgaaagtttttggcaaaactacaaataggattatgttagcatttacactgaggagaaaattgtcaatttaagaaatctaaagtgaaaattttgcttagaaataaaatatgacaagttctgttttgagtttgatgccataatagtttttaaggtatctaacaataatttatagatgtacattgtggaatgtaaagctttaagaattttttaagaagtaataattaaaataacctcacaagaagttgtaatgagtacagagaattcccgtgtacccttcaccaagcttcctctaaggataatatataatcatagtatatggtcaagtccaagaaatcgatgttaccttgctagtagatgcagacttactcagattttgctatggtttgcgtgcactctgtgtgtgtacgtgtatgtgtgtgtgtgtggttataacaaactggtacttttacatttgagtaaccatcaacacaattagtttacagaatggaaaaggagtctgagatctgtactgtttcaggattacaaaggaatcaggatttagcctcaagtagttcccttgttgtattaataaccacaccctttctgcatccctgtccctggcatccacttgactatgaagctttttgtaaagcatagataaattgaataatcagggcaacagcattaagcacatctgtgaattatccctgaagttcataggacttacatatgtacaagtggtatgtgatataaatcgtgtgtttcatatgcataatggtatttaacgtaattgtgaataggaagtaggtatcctaatttagtagtggttacttcatcaggcccatcccaggtgtttgtcgtgtcctgaaacaatttaaatagagacccacagagctaatgtttatccatttaaaagttataaatcaaaataacagattatctgaaaaaaaatctatcctgtacgtgtgaagatctaggcctgcctccatgttactccctttctcttactacctgtggctcatcccatgccatgaactgcctggggtacatatgtgaacactccagccttcagcgtaagtgatagtccaaattttctttaagcagctgctctccaagacagggccctggaaagaggcccacacatacagcccagttgctgcccagggctgttggactgtcatttcattgctcattgtacccagacagggatctgggccttcagagacttttgagaatatgaagaggagggttgaggctggagaagagccagaatcaagctggcatggggcttttattgacagtgtgaagattgtacactacattacatgatcagatcatacaaataatctaagattttacagtctggtgaccctagattacacaagtaatctaagcttccactttggaaaactagaaaaagaagagcaaattaaatccaaagtaacctggaaaaaaattagagtaaaaatcagtgaaattgaaaagagaaaatcaataaaacccaaaactgttctttgaaaaggtgggtaaaattgataaacctctagctagattaagaaaaaacagaagacaaatactgctaataccaaaagtgaaagaggccatcatagctgatcctatggtcaccaaaaggattagaaagaaatatggacaactctgtccataaatttgataacttagctaaaatggatcaattccttgcaagatgcattctctcaaagctcataaaaggtagatctcagtaggcatatatatctattaaataaattgaagcagtaattaataaccttccaagaccaggcgcggtggctaaaaatacaaaaagttagccgggcgtggtggcatgcgtgtatagtccaagctactcaggaggctgaggcagaagaatcacttgaacctgggaggtggaggttgcagtgagccaagattgtgccactgtactccagcctgggtgacagagtgagactccatctcaataaaattaataataataaaaccttccaaaaaaagtgccgggaccaaatggattcactgatgtgcatttttcgagatacttaaggtagaaatgataccaagtctgtactgtctctttcagaaaataaaagcagggataacacttcccaaatcattttgtgaggccaggattaccctaataccaaagccaggcaaaaacattacaagaaaggaaaactacagatcaatatttccagtgaacacagatgcagaaatccttaaaatgttagcaaatcaggaatgcaagccttgttcaacatttgatattcagtgcaatccattgcatgcattagcagttcaaagattaaatatgatcatatcaataggtacagaaaaagcatttgacaaaatccaatatccattcatgataaaacctctcaacacagaaggaatacaggagaacttactcaatttgataaagaactactacaaaaaaccctacatctagcatcatccttgatgtttccaactaaatgctttcctactaagatcaggaacatggcaaggaacaccactgcttttcagcattgtactggaagtgctatctaatgcagtgataccaaaaaaaaaggaaataaaatgcacataaatttggaaggaggaaatacaactgtctttgttctcaaataacatgattgtctttgtagaaaattctaaataacaaaaacctgctgacattaataagcaattatagcagggttgtagaatgtagtcctcaggtatatgataaaaaagaattagacatcaagtcattaaaagacatataggaaccctaaatgcttattgttaagtgaaaaccaatctgaaaaggctttctatgttgtatgattgcaattatatgacattctgggagaggcaaaactatcgagcgagtcaaaggaccagtggttgctgagagttgaggggaaaggagggatggcaggtaggtgatttttaggacagtgaaagtactctgtagggtactgtaatttgtcaaaatgcagagaatggaaaacagtgaacggaaaacacagagtaaaccctagtgtcaactctggacttcagttaataacagtgtaccactattggctcatcaattgtaacaaatgaaccataatgatgcaagatgttaataattggggagcctgtggaggatgggagggttaaaggtttatatgagaattctctgtactttttgctcaatttttctgtaaccctaaagctgctctaaaaaatgaagtgtattaagtaaataaataagtaaataacc

SEQ ID NO: 35135 - DNA, 2446 bp, Homo sapiens
ccttttgtttgtctcacgttttgcgtgggaggcggtcccgggatttcaggggtctaccggctctcttatggcgaatgcaacccgaagagagagtgagctgtatcttcagagttgtctccgtctttccaagaacagaacaaaatgaacaaggtagatcagaagttccaggggtcagtatcatttaaagatgtgactgtgggcttcacccaggaggagtggcagcacctggaccctagtcagagggctctgtatagagatgtgatgctggagaactacagcaaccttgtctcagtggggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcacgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattcacaccttacagtacaccagagaactcacacaggtgagaaaccttttgaatgtcttgagtgtgggaaatccttttgtcaaaagtcacatcttacacagcatcagagaactcacataggagataaaccttatgaatgtaatgcatgtgggaaaactttctaccacaagtcagtactcaccaggcatcagataattcatacagggttgaaaccttatgaatgttatgaatgtgggaaaaccttctgcttgaagtcagacctcacaatacatcagagaacgcacacaggggagaaaccctttgcatgtcctgaatgtgggaaattctttagccataagtcaaccctctctcaacattatagaacacacacgggggagaaaccctatgaatgtcatgaatgtggaaaaatcttttacaataaatcatacctaacaaaacataatagaacacatacaggggagaaaccctatgaatgtaatgaatgtggaaaaaccttctgccagaagtcacaactcactcagcatcagagaattcacataggggagaaaccctatgaatgtaatgagtgtggaaaagctttctgccataagtcagctctaattgtacatcagagaacccatacacaagaaaagccttataaatgtaacgaatgtggaaaatctttctgtgtgaagtcaggacttattttacatgagagaaagcacacgggggagaaaccctatgaatgcaatgaatgtgggaaatccttcagtcacaaatcatcactcacagtacatcacagggctcacacaggagagaaatcttgtcagtgtaatgaatgtggaaaaatcttttaccgtaaatcagaccttgctaaacatcagagatcacatacaggggaaaagccctatgaatgtaacacatgcaggaaaaccttctctcaaaagtcaaatctcattgtacatcagagaacacacataggagaaaaaccttatgaatgaattggatattagaaatttccagccacaagtcagcctccataatgcctcagagtcttcacactgtggagaa

SEQ ID NO: 35136 - DNA, 1901 bp, Homo sapiens
ctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaa

SEQ ID NO: 35137 - DNA, 1926 bp, Homo sapiens
ggccgaacgggcgaggttgggctgccgtgctgctcggcggcgctgaggccaaatagttgcatcacatgtatctaatccgagagtctcatgcttctggtagctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaa

SEQ ID NO: 35138 - DNA, 2680 bp, Homo sapiens
ttggcggggagggagggccgaacgggcgaggttgggctgccgtgctgctcggcggcgctgaggccaaatagttgcatcacatgtatctaatccgagagtctcatgcttctggtagctcctcagtgaccagctcctgctcactgccctcagaaagcccaaccctcaggcaatggcggccttgttcctgtctgccccaccccaggcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaagcagtgcatgttcattttagagaaattgagacagaaaagtgggcaaaaaagaagcttctgtgatctctcccacttagaaaaaaaattcattgctgctgatttacgaatattttcgagacatactggagagcattttaaaaagaaaataccgtaatgcttgtcattgcagcacctaggatcttcacttttgctatttcctcaatatcagaaaattcacactgaagagagcaccatatattttaacatttttacatattgtaaatttaaaagcatcggccaggtgtggtggctcatgcctgtaataccagcattttgagaggccaaggtgggtggatcacttgaggtcaggagtttgagaccagcctggccaacatggtgaaaccccgtctctactaaaaatacaaaaattagccaggtgtggtggtgggtgcctgtaatcccagctactcgggaggctgaggcaggagcattgcttgaacctgggaggcggaggttgcagtgagccaagactgtgccactgtactccagcctgggtgacagagcgagacgctgtctcaaaaaataaatgaaacaaacttaacattcatactttttatgtcaatagagttgaagttgcctttaactgtggtgaaataacataatatgaaatttacaattttaaccatttttaagtgtacaattcagtggcattaagtacattcatggtgttgtgtaaccatcatcactgtgtatttccagaactgttttattactccaaacagaaaccctgtacctattaaataataactcttcatttcccccttctccctactgctggtaacctcaattctattttctgtctctttgaatttgcctattctaggaacataaatatgtgtggaatcatgc

SEQ ID NO: 35139 - DNA, 2661 bp, Homo sapiens
acttcctgtccggtcattgttctcgtgccggtagaagctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatgccc

SEQ ID NO: 35140 - DNA, 620 bp, Homo sapiens
cattgttctcgtgccggtagaagctgaagtaccggtcagccagcctcctgctgcagagccagtgaactcaggtcgggcttctcagctgcgcacagcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaa

SEQ ID NO: 35141 - DNA, 532 bp, Homo sapiens
cattgttctcgtgccggtagaagctgaagtaccggtcagccagcctcctgctgcagagccagtgaactcaggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctag

SEQ ID NO: 35142 - DNA, 1790 bp, Homo sapiens
attgttctcgtgccggtagaagctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaa

SEQ ID NO: 35143 - DNA, 1745 bp, Homo sapiens
agcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 35144 - DNA, 3026 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggactcgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagct

SEQ ID NO: 35145 - DNA, 1727 bp, Homo sapiens
gaagaatttgggggattttgcaaatgacctgaagcctgagaggaagtgcaacactgcagggctctcaggagggggtaccctgctgacgcctgtgactaggcctaaccttctggggtcctgcggcccagtgctgcacactgtcatctgccttgaggtgcgcctggggtccagattggccgatgaatacgtacacccgcagcgcctccttcactccgaagactttcactttcccccttgcacaaaaccgaacatcccaccccaccaccacctccaagctaaaatacctgggccgcccctccccacgaagggacgcgctccaggcgaatggggagggcccggaagtcgggcctgggacagaggagccggcccaccgcctcccggtcggaagcggcagtgcaggtgaggcggcggccagcctggggactgcgcgggtaaggagcgggagggcggaatgcaccgcgaagttggcgggggacggccacgcacgcctcgcctcggccttcctgcaccgtagggccgccctcccgccacccctgggcacctgtcgaccacgtctgggcgagggcgggtcggctcccgccctcgggccctcaccgcggcggggacgccgggtcagcgaagggttaagggactcgctccctcctctcggctccctcacccttggaaagtccccgaaatgacgtttcaacccgacaatttaaaaaagagtttaattatagagacaggctctgggagctggaacaaacccttggtcggcggggccggtaaacaactcgggagcgagcgggctaggccagtcgcagccttgcggagcccgcgcccccggggagagggggaggggagggcctccgggagttggaaaagccgaggaaattcgaggaatcagctttctttggaaaaatccactttgtagccattctggggcgcctgatggtgctcctggccggtcccgcagccttggagggaaagcggcgccgcccgaagcaggggcatagccggtgccccgcggggacaggccctgggccgggaagggggccccgcccgctcccagtccccttcccctttgcttttttccagcccctcctccggtccccccagctgagcttcgcgaaccctcgggagttaaagaccagccggcctcttttttggggggggtggggggtgggggagcgggaatgggtggaggccgggggaataaaaaaccgaaatagcttcacatcagaactcagactaaccttgtggtttcaacgcgcactctgctctgtcctgaaatctggaactcattacctcatcaccaagaaactgcacgaaatctctcccccaccgccccaacacccacttgggaaaggaacgagcaaacatccctctaagaaagaaacctacacttgaatgatttaaattaaggtggatggaagttatttccctttctggcgcttgccagatttcaagaaaagctgaaaaatgggagcgggggagggaagcaacagacggctggagggcagcagcagaacaagcgaggggcagcagccgagttaaagtgggggccatccatttcgggcagaggagacaaatgaaagccgaccccgctgggatcacgtaggttcgtggctgcagcaaaagttgggtttcacaaagttgaaaaacagccggtttctcaaacaattgtgatttggaaggtttcgctgggtttgcccagatgtttacgaataaataagaaatgcagtttt

SEQ ID NO: 35146 - DNA, 1236 bp, Homo sapiens
ggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctca

SEQ ID NO: 35147 - DNA, 3190 bp, Homo sapiens
gtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaa

SEQ ID NO: 35148 - DNA, 3696 bp, Homo sapiens
gccgagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcggcggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaaaaaaggta

SEQ ID NO: 35149 - DNA, 2695 bp, Homo sapiens
gaagaggaagagagacccgagctagcacactcagtccccttgctatgtgatgttctttaccatctcaggactctgcacagagtccccaacagcaagaaggccctcaccagatacagccccttgacctgggacttctcagcctccataaccgaattggcccctacaagtcaagttgcaaaccctgggtcaaagggtgaagtagaaggaagctggaaacacatagtattttagaagtttttcagagaaatcacaaggcaggaacttctgctcagtttggaagaaagagcattccatcatgacccttggactgggtgagagcatcatcctttaattaatgtctgcgctgggtcagataaccatcactgtctccaggtgctggaatacagagaggaaccaaacagataaaaatccttgcctgcacggagcttaccttcagctaagggagacagtcaaaaacaagtcaacacatctaaagaagccactgatgaaacaggctcccccttggaaagaccatctcaccttccaacctctccatcctgcagagaggaaaacccaagtttggcgttggcagtcaggtaattcatcagatctggaaaccacctcatcagcatccccctggccaactggaagcaaccgtgacgttgtgctgaatacacttgcagagtcgtgctgtggtctctccgagctcatcacggcacctccctatgcaggagtttcaattcaaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccctgtatccacttgggagagagcctctacaacatgctggcaacttccccctcactgattcaaatgttaatctcctttggcaacaccctcacagacacacccaggatcaatacgttgtatcctttgatccaatcaagttgccactcagtattaaccatgacaccttctaagccatcatctcctcctaatcctcccataacaatgggtataagttatgaaggtgggttagaaactagtgcctatccctcactaagttgccagatggatttaacagcacctcaaagtcaacatgccccaagtcaaagtcttctttacccatggaataagctggcttgctacttccctacatctctgaagggctccaccattcctctagcaaccatgctctcaaagctcagagggaggaaaaggaaatggatctaaatggaattccaggtcccacgctggatattttcacaccttacctcatttaatacaacaagcaaggaggtagacaatattgtctacctttgcaaatgaggaaacagaggcttagagaagttaaataatttgcctgagaataaagctaaaagtagctttaaaatactagagctgggattgcaagtttgatgcaaagtttgtgctctcttcatccttcaccaagatctttcattttccctttaaatatctcttatgtctgcatttcccttccattcccatcactagcactgtcctctaatgccccacccagtggggaagtctccaataggtccccctgcttataacagccaagagggtagctataaactaggtccaataacatgcttcatgtgagggaactgatggacagctgtctaattcataacctctggcctcaacggaatttacagttcagagtccaaaatagcaaggaagtggtgggaagaaggtgagagaaaagggtgggagggtgagagaggggagggaggggaataaggtgtgggcagtagagggaatctgtcagtctcatggtttgccctaggaaaccttctgctcagccccagcctgcttctgggcactcctcctcacccctccttgctgtccatatgggttcaatgtgagtaaccacaattgtagagtgtggccatcttcttctgacatggtcctaaataaacctaactgagtagccagaagaatcacttctaaggtaaacatctgtaaacattggttatatttattttcaatattactggttaacattgtggagctattactgatgggccagactctgtgctaggcacagactttctagggattatttcatttaattctcatggcaaccaccatgcatttgcagataggcaagtcaggctcacaaaaatgtatgcagagcttcagggttgtgatgggtagagccaaacccatctgcccaacccaagggcccgtgcgctccaaccctgcatcgaactgccaacatagtacaccttttagaaaaagattcttgttgcaaaagtaccataggcagtgtgtgtgtaaggtcattgtaaaagtgtagataagcaagaaagtgttataccaccactcagaagtaaccactgttaacatgttggcttatctgctctcaggtgtttctgtgcctgtacatactattcttcttgaataaaaacaggattacacagtgt

SEQ ID NO: 35150 - DNA, 4173 bp, Homo sapiens
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgcttacagacatctcctcaaataggaagcccaaatgcctaagccgagggcacccgcattcggtatgtaaccaccctgatctcaaggcccatttccacccaaagggaaggaaccacctgaaaaaggccaaggatgacagagccagcatgcagcctgccaaggccattcacgaacaggctgagtcctcaagagacctctgcagacctccaaagaaaggggagctcctggggtttggccgcaaaggcaacatcaggcccaaaatggctaaaaaaaagccaacagccattgtgaacatcatctaaaagggtgggtggtgctggaccaatcatcgctgggctttggggaacgttgttccaggagccaacagtaatgtctttctggaaacattccatagtaagacacattggaaaagccaagggcataacacaggcaagcacctcaattaaccagagcttagcaaatgggaatcttagtgaaccagaattttattataacccccttttagaagcttgcaaattacagaaagaataaaaaaattaaatcaatcttaaagctctaacttctaaagtaactggcccagtctccagtaatcttggcatctgggcttctatgcagtggtcactaattttcaggaccaaggccacacaaaatgtcaggcctagggagaaaattcatctgtgcccactgctctccaaagtgcgaggcaaggaatggcagtgtaaagttctgttaatagcagtaaaatgaaaatatttgtgtttgtgtataaccttcccctcagctaatttgaaagcctccaaaataaggattcccattccccgagtattctggttaatcaagatttcaatttctgggttgctcaagggactcgttcagtcagacttcagttctcattccgacagggtgtctttcagttcgtttgtttgattgaggttttttggtggcctagatgcatgtttattcagattttggtacacctctgccgtcttctttggctgagtattctgcacccacagaccatgctgccagcctctatcttaatagctgcttctgtggatatggctggggagcgaagtaaaatcctcttttgattagcacccagcatgggctgggtggctaggtggttggaatgacagtggactgcacgcttggtgcatcgtgcatcgtgaccatcctggaagcactgcgggtgtcgccaagccctttcctaagacctgcttcccggccagtgtcagtggccctctctctctctgctatgggcatgactttctcttcgctggcttaacttttccactgggtggttcactttgcctcctgctgcttctgtgccctgttaagggcttcaggtatctttcaaccaagtatctggagtgttcactctatgttgcattctaaagtaatttctgaaataaacaatgcatgtaggagccagaatctgacactgtcttcccctccttccctccctaaaatggctttagtttccacaaagagctgttaagaatttcctgctgtatgattttcctcaagaatgaatttccatgttattttttccttaaatttagcaatatcatcaggtctcttgcagagtttacaagtgctgacattcttctgaaaacaggaataattttgtccacaaatatatacatatatacatatatataacacatacaaaatatatatgttaagtatattaataatttatttttaaatactcatggagaaagtgtgtgtttgtggtgggtggtttttaaactatatatgtttgttcatgtaaactgaattctcttatttaaaaaatcaaaactgtaacgtaattaacattggcagaattatgattgttactgcaataagcatcaaattagcagcgcattaaaaataggaaataaagcagttgcttaaaatgccagtcaattgaaaagtgtaacttatcattatacaaacattctgaacctaccataatgaaaatgttcttgaatcttcactttgactttcagtttatggggggggtagatcattcatgtgatatataagcagctatcaagtgggcaaaaacattgctgtgaatagcactgtttaggctaacattgtaaaaattgtaatgttataattattatttatttggagaattaacttccccctctaaagttatttattattgatgcttataccatgattgcaccttagccttttacatactaaaaacatgacttgttagttgtattgcatgctctttgtcctgtaatgtgtgtgcaatgacaacttgtttctgttttatttaaagtaactgacattttggattttcatctaacatagagggcatggcaactctctttgacagtggtaccccatgatcttcagaaagtaccataatgtcatcctactctacatttcacaagacgaattattttgagatttgtttattatattaaaatgtttttttacgttcccactaaattttgaccccatataaagaaatgtgttatgtatgttgtgcctccttagagacataaatttagtgtcaaaacatgggagatggcttactcagaagcatactccacttaacataccatggcctgagctaagtaccatgtcctgtttgtgtcttatttttaaatattttctttgtccacatgggccgttgaccttagagttaaggcggttgcttttttgaagaaatcaccaaagtttctgggaaactatgttcaaggttgaaatggagagtagatttaattttatttgtcttgtagggaagaaatcttcctttgaaccgcttttcttgctttttccctttttcccaaactaggttacaggttcttatctgcaaggttcaagttgcttagacattgttttccagtattctgcagggccagtcagttgtacagaagttggaatattctgttccagaattaaagaagtttttagattatgaaatattatgataataaagctatatttctgactaatgtgttga

SEQ ID NO: 35151 - DNA, 1674 bp, Homo sapiens
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgagctggaaaggtgctggcgaagctcgcctggtgtgccaaaatgacctggaattggaggagtctgcgattgtggaataatgaacttcgaatgatgtgattctggatgaggacttggatcaagagaatcgcaaattaattgtgccagagaagctttcattcattcaacaaatatttattaagcatgttttacactccaggaactttacaagaaacttgggctacttggtgactttactcaccaggagtgggttcagactcctgatggatgagctccaggtcctccctaacaagactgcagacttcctgagggcacagcccacccctcatgctttgagtttctcatataacccatcatagcaagtagaagatgcttcagaacatttgtccctatgagatagagtcatattctatttagcttgggacatggcaggtactcagttgttaaataaaaaatagttattgagtaattt

SEQ ID NO: 35152 - DNA, 3379 bp, Homo sapiens
gttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgagctggaaaggtgctggcgaagctcgcctggtgtgccaaaatgacctggaattggagatttttggccatataaaccaccatctttcggggttgaaagattctcattgtctagtttttctgcaagccccacctgtgccctggatcattttagccagctttctctggattctcggaaatccctggacgtcttccacggctactgcaggatttagccaaatttgggtgctatttcccttttgtggagggacttttcatcacaatgagaaggacgtcttaggactccaggactttgagagagaaagtgtctctacaagtcaaagcaggaatatcagccttcttacactaggacaactccaaaattgtgtgattggcaaattgacaatcatcgatttgttgactgaacacctgttaggtgtaaggcacggtgtcatatgctttccttggggcttgccttcaagcagctaacagaaataagaagaaaacaggtgaaaaagacagtgtgataaggccatggtggtggattgtggatgccctgccctgtatccacttgggagagagcctctacaacatgctggcaacttccccctcactgattcaaatgttaatctcctttggcaacaccctcacagacacacccaggatcaatacgttgtatcctttgatccaatcaagttgccactcagtattaaccatgacaccttctaagccatcatctcctcctaatcctcccataacaatgggtataagttatgaaggtgggttagaaactagtgcctatccctcactaagttgccagatggatttaacagcacctcaaagtcaacatgccccaagtcaaagtcttctttacccatggaataagctggcttgctacttccctacatctctgaagggctccaccattcctctagcaaccatgctctcaaagctcagagggaggaaaaggaaatggatctaaatggaattccaggtcccacgctggatattttcacaccttacctcatttaatacaacaagcaaggaggtagacaatattgtctacctttgcaaatgaggaaacagaggcttagagaagttaaataatttgcctgagaataaagctaaaagtagctttaaaatactagagctgggattgcaagtttgatgcaaagtttgtgctctcttcatccttcaccaagatctttcattttccctttaaatatctcttatgtctgcatttcccttccattcccatcactagcactgtcctctaatgccccacccagtggggaagtctccaataggtccccctgcttataacagccaagagggtagctataaactaggtccaataacatgcttcatgtgagggaactgatggacagctgtctaattcataacctctggcctcaacggaatttacagttcagagtccaaaatagcaaggaagtggtgggaagaaggtgagagaaaagggtgggagggtgagagaggggagggaggggaataaggtgtgggcagtagagggaatctgtcagtctcatggtttgccctaggaaaccttctgctcagccccagcctgcttctgggcactcctcctcacccctccttgctgtccatatgggttcaatgtgagtaaccacaattgtagagtgtggccatcttcttctgacatggtcctaaataaacctaactgagtagccagaagaatcacttctaaggtaaacatctgtaaacattggttatatttattttcaatattactggttaacattgtggagctattactgatgggccagactctgtgctaggcacagactttctagggattatttcatttaattctcatggcaaccaccatgcatttgcagataggcaagtcaggctcacaaaaatgtatgcagagcttcagggttgtgatgggtagagccaaacccatctgcccaacccaagggcccgtgcgctccaaccctgcatcgaactgccaacatagtacaccttttagaaaaagattcttgttgcaaaagtaccataggcagtgtgtgtgtaaggtcattgtaaaagtgtagataagcaagaaagtgttataccaccactcagaagtaaccactgttaacatgttggcttatctgctctcaggtgtttctgtgcctgtacatactattcttcttgaataaaaacaggattacacagtgt

SEQ ID NO: 35153 - DNA, 489 bp, Homo sapiens
ttgcaggcttaatgccactgtgcatagcttgagtaatctttcctgtacttgaggataggtcctgagcttgctgtcttaggacccattttgacaattcatgtgagttttcatatgttcttgtgttcacgcatctcggattgtatccttaaaatggggcacggttttgcatttagtgtgccaaattcaggaggggaggaaacttgaattccacttctggatctaccactttccatctgaccttggattaatggctttacttccttgcttcagtgttctcttctgtggagagggaatgttacccacctttttgattctaggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctac

SEQ ID NO: 35154 - DNA, 6266 bp, Homo sapiens
cgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagcagaaatctttttaaaagggttgttatatatgtaaaaaatgttaacaggaaaatgagagaaaataaagcagctgaggatacaaatgtgctggtagggagcgatattcaagatatattgtgaagtgtgaaaaagtaggttgctgaaccatgtatatagtatgttcccctttgtgtacaaaagggtatgtttgtttaacctctgtctcttatctctgtatgtgtatgtatctttgtatgcatatatacatgtatctgtatgtgaatagactttgaaaaaatacagaataaacttcatggtggttgccattgggcagaggagtataggactggggtctaggataggagcaagacttccttgtatatttggatttttaaatcatgcacatgtattatttttataattaaaatattttaatatgcataaatcaacattatttaaggttgtcactgagcccctccacaacatgtgagatcaacatgtgagatctcagattttgacagagttaaaatctttgtatgcttattcatgaatgatgatgaatctaaagtatatagtatgaaacttgatgttgaattcataaagactttttctatcacacacaagttctttcattaacatagtgaattataacagcactgtttctacatttgccattttttgatgttgaattgtgattgcaggtgatgatgaattgtgattgcaggtgaatgaaagtgattttatgaataatcaccctgttttatctcatattcaaagaactaacacacaaacacctcaatcagggaattcgaatgaaacaaatgtcacccctccctgttctcgctcaatattgggcattatttactggatcactgtactctttctgagtgaacccagagttggcctcagaatcattgtgcagcgtgcattccagaaggtactatgcatcaacttggactgtcacaggagacctatttgccattgcacacctggattttttttactcttgagccatagattaaaaatacttctggctgggcatggtgggtgcctgtaatctccagcactgtgggaggccaaggtgggtggatcacttgaggccaggagtttgagatcagactagccaacacaatgaaaccccatctctactaaaaatacaaaaaattatctgggcatgctgtaatccctgtaatcccagccactcaggaggctgaggcaagagagttgcttgcacccaggagatggaggttacagtgcactccagcctgggcagcagagtgaggctctgtctcaaaaaaaagaaatacaaaaaatgcacaaaacttctgaactattttgaaatctaagttgttacactaaaagcagagacataagtacagaaatggttttcaaaaacatcatacctttattttaatacaatattaatttacataatataaaatattataatttggcatgttatcttttatattttttaaagcacaatccctacattatttcatttattcctcagaactaacatatgagcagtaatcgggacttgtctagtcatgttcaatcctgttgagtaaatatttcacctagacagtaatttagcataataatgggccccaaagaaatatgtgcttaaatgccatctttacaaatatttatcattcaagctccttccttcctgacctcatttcagagaattataatgtgttaatataatatattgagaatggaatatgtgttcgtgtatgtgcatgtgcacacatgcatacacatgcacgggttgaaagctcaactcatgaatatatcccctcatttccaagtaacttatttatcacatgggaagaaaatgcaatatgaaagccatttctaccagtaatttcttaacaagtggaaatatagcactatgcacagaatgagtcatcactgtctagagctgtagaaagcctgcactttttagatggatgaaacagttgcaggttatggctatgttgaatttccacatgtcttggggaacccatagtattgccacatctgagacagtgagaattataggtatgcctgaatgatataaatgaatgctgaaagccactttgtgcagtaataaaatgaattaaaagttagcattgatgaatgaggaaaggatgtctaaatacaattggaggttagtataggaaaacagacacacagtggtaagtctgaatcgatacgtaaactctagtgtgcataaaaattgcctgaatgatttgttaaaacacagacttgagaatgcaaattcttgggcctcgtcacagacatattggatcagaaaccctgtgggtgggccttgagaatttgcattttaataagtttccagtggattcctgtgctgctggtctggggaccaccctttgagaaccactaatctaaatcatggtgtaagtaagtttaaaaaattatttttaaactgtttttcagatcctctttaagaaaatgaaggggcataaaagtaaattattattaacagttttgaaacatttatttattcaagtgatatgatcatctaagtgcctgagatacagcagtctacaaaacaaaaagaaagcaaacaaacaaaacaaaaccctgttctcatagaccttaattctagaggaggacataggtaataaataaacaactacaatataaagtataacagatcactggatggcaaaaagcaaaccaaggaaggggagggaagtgttggggaatgtaattttaaatatagtgatgggaagcaggcagtaagcttacttagatggtgacaaaagcaaagacccagagagggtaaaagagcaaaccatgtatatatatatgacggaagagcattccagggatatatcttttagaatctgagggtgtgggaagagaaagatgttaaactcctctgacataaagaagaggaaaaaaagtggaaacatttttttaaatcaagatttaaaaaaaaattacatttgtgataggtagaaaacaatctgtcacacactgcttttggtagttgtgtaagtttgtacaacctaccaaaatgtaaatctgacagtatacatcaaagccttatgatggtcggcagtccatcgaggaatctattctatgttgtacaatcaaggcgtactatgatatttattgcagaacagagagaaatagcatatacattgctagttaattgattaaataaagcatgattccttcaaaaattgagtaatatgacattaaaaaccacaatttcaaactatatttaagaagatacaaataattctttattattacttttactctcaggaatgtgtttgagtgatgcatctccaggcatcaagtgagtaatccaatattgaagaaaattaaaattttccacaaagtcccccttctagaagaatgtgctcatatcttttgaccagaaatgagtcacatgaccacacctagtttcaggtggcttgaggaaattgaatctttctttttttgttttattttgttttgagacaaagtctctgtcacccagactggagtgtgcagtagtgcaatcttggctcattacaatctctacctcccaggcttaagcactcctcccaccttagccttcctagtagctgggactacaggtgcatgccaccaagctaattttttttttttttttttggtggaaacagagttttgccatgttactcaggctggtctcaaacttctgggctcaagtgatctgcccaccttggcctcccaaagtgctgtgattaaaagtgtgagctaccacatttggccaaatctttaatttcttaaccttcatagtaaaggaaataaagagacatgggcattgaaaaatggatgttgtacaaaccaacctgtagcatctaaaatactaaataaaaaacagtttacaaaa

SEQ ID NO: 35155 - DNA, 1969 bp, Homo sapiens
atgtcggtctccagcggcgtccagattctgacaaagccagagaccgtggaccggaggagaagtgcggaaacgaccaaagaggccgggcgaccactggagatggctgtgtccgagcccgaggccagcgccgcggtatcagtaacattcaaacatgtgactatggcctttacccagaaggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaattt

SEQ ID NO: 35156 - DNA, 2451 bp, Homo sapiens
gtgcgctattaccgaagggcgccgccatcgcggctgccggacccgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcgaaggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagca

SEQ ID NO: 35157 - DNA, 2813 bp, Homo sapiens
gactcaccctgggccgggggtgaggcttggactgtttctttttccaaaagaggagctcaaaagagaaagttcatctagaaatctcaaagccatgtctcaggatgaactagagtatgcccttacagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaacatacttgtcttggtgtacatacatgtatttctcttgtgtatatacttaggagtggaatcgctgggtcttagagcatgtgtgtattcagtcagatactggcagacaattcagaactttcaccacatgagataattgacactgaagggaaacagctataaattttatcaatatggtgctggttcaaaccagagaattcatgctgcagggaaactcaatcaatgttattgtgaaaactgggaatgtgaatgtaatatatgtagaaaaacatttagccacagcccaaatcttccaggcaaatgtaataaacgtgacattgccgttagcca

SEQ ID NO: 35158 - DNA, 2742 bp, Homo sapiens
ggggtgaggcttggactgtttctttttccaaaagaggagctcaaaagagaaagttcatctagaaatctcaaagccatgtctcagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaacatacttgtcttggtgtacatacatgtatttctcttgtgtatatacttaggagtggaatcgctgggtcttagagcatgtgtgtattcagtcagatactggcagacaattcagaactttcaccacatgagataattgacactgaagggaaacagctataaattttatcaatatggtgctggttcaaaccagagaattcatgctgcagggaaactcaatcaatgttattgtgaaaactgggaatgtgaatgtaatatatgtagaaaaacatttagccacagcccaaatcttccaggcaa

SEQ ID NO: 35159 - DNA, 3069 bp, Homo sapiens
gcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttttttttttttttttaaatcatggcagatttcagaggaaaggaaattaaaaaaaaaatcaggaaaccagttgttataaagtaatttaaaaatgaagaaaaaaagaaaaaaacttatgtacaaaccaaggggtgtttttagaacattgtatagaaataaattcatgtaaaagga

SEQ ID NO: 35160 - DNA, 2978 bp, Homo sapiens
cgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggatccactccaagatgcacacggagaccatcaagccccacaagtgcccgcactgctccaagaccttcgccaacacctcctacctggcccagcacctccgtatccactcgggggccaagccctacaactgttcctactgccagaaggccttccgccagctctcccacctccagcagcacacacgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcata

SEQ ID NO: 35161 - DNA, 3286 bp, Homo sapiens
gaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttttttttttttttttaaatcatggcagatttcagaggaaaggaaattaaaaaaaaaatcaggaaaccagttgttataaagtaatttaaaaatgaagaaaaaaagaaaaaaacttatgtacaaaccaaggggtgtttttagaacattgtatagaaataaattcatgtaaaagga

SEQ ID NO: 35162 - DNA, 2509 bp, Homo sapiens
gctatttccctccctccccccttttcgtttccggcgctcccgccttctctccgcagagctcttctctgagcctgttggggggagggaggggggcgtggaggaactggggttcgcgggagcacgagctgcagcaccacttccgggtgagtgcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctc

SEQ ID NO: 35163 - DNA, 3008 bp, Homo sapiens
gctatttccctccctccccccttttcgtttccggcgctcccgccttctctccgcagagctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggatccactccaagatgcacacggagaccatcaagccccacaagtgcccgcactgctccaagaccttcgccaacacctcctacctggcccagcacctccgtatccactcgggggccaagccctacaactgttcctactgccagaaggccttccgccagctctcccacctccagcagcacacacgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttt

SEQ ID NO: 35164 - DNA, 1067 bp, Homo sapiens
agttcagctccctggaggggaaggagggacgtcccaaggaagggtctttgagaaaggggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggagcgaagggaactgcggcacaggaaatggacagagccttgggctcatggattcagttcccggctccaccacgaatttgctgtgtgaccctgggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccg

SEQ ID NO: 35165 - DNA, 1096 bp, Homo sapiens
tcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttc

SEQ ID NO: 35166 - DNA, 2514 bp, Homo sapiens
agctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctgccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaa

SEQ ID NO: 35167 - DNA, 2331 bp, Homo sapiens
agaacggcccccgggacagagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgcc

SEQ ID NO: 35168 - DNA, 2076 bp, Homo sapiens
agagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccg

SEQ ID NO: 35169 - DNA, 2430 bp, Homo sapiens
attgctctggagccagcaggggaagtgtgtacactatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctcc

SEQ ID NO: 35170 - DNA, 775 bp, Homo sapiens
cagaactggacctgtagctgagcattcctggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaacc

SEQ ID NO: 35171 - DNA, 2494 bp, Homo sapiens
gggcagaaccaagggaaggggacgctgtcaggcccaggcccctggggggccagggccaggccactgcctgggggcagcaggcatcagaaactaaaggatgaatcacccacttgactctcttcttcctggggcgataccaagctttaggatcccctgggggaaagcaaaaccagaagaagagggtggccaggggcttgaggctgggagtcctgctggttcagcaggcagcctgcagaaaaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctg

SEQ ID NO: 35172 - DNA, 568 bp, Homo sapiens
attgctctggagccagcaggggaagcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttc

SEQ ID NO: 35173 - DNA, 545 bp, Homo sapiens
agaacggcccccgggacagagcgacgcggaaccccgggcgcctgggtccccagcatgatcctcgcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagc

SEQ ID NO: 35174 - DNA, 2369 bp, Homo sapiens
ggcagaaccaagggaaggggacgctgtcaggcccaggcccctggggggccagggccaggccactgcctgggggcagcaggcatcagaaactaaaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctccgcc

SEQ ID NO: 35175 - DNA, 1111 bp, Homo sapiens
gacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactcccta

SEQ ID NO: 35176 - DNA, 2610 bp, Homo sapiens
agtaattagagctaagcggcaattacaggacgtatgatttgttcagaagcactgcctgccggctgtttcctagcaccacatttcacgggagcaccaggttgagatgatggaattatttacttttaaatgtaacatctcgtacagtgctcaaatgcagacgtgaacgtggactgtaaccttaaaaacaaaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtac

SEQ ID NO: 35177 - DNA, 2750 bp, Homo sapiens
agtgcttctggtttcagcacacatggagatatagaattgaaattgctctgctttctttacaaatgactcagagtgtgcttgtccttccctaaaatgttgccagcatgtaaaggattttcaatgagcagtgcaataagccagcaactgggaaggcttggagcggcactgatataacgtggtgctgtcacacagataatcagggctggagccaagtctcggtagcgctgtgcattatcctggtcacatactggaagttttgtttatccaacttggttgctcttgaagctggtgagagccctgccaggatgtggagtggacttcctagcagaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtac

SEQ ID NO: 35178 - DNA, 2109 bp, Homo sapiens
agtagactataagcttttggaaaacagggactatgtcttcttcaacaatgtgtacacaacaagtagcaggttgtttggcacatggcagatgctcgatacgttgatctggcagcggcatgggagatggatccaaagagattaaaactggagtgaaggagtccagtaatgatgtgaagagatgagggtctgaactaggacagaagtcagtcacagggatggatttgagacgttttggagggttacacatgcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatg

SEQ ID NO: 35179 - DNA, 3288 bp, Homo sapiens
gcacgtccaaaccccggggtcctcggccaggccaggggggcgggcgtgcggcggggccgggccgggccgggcgcgcccagcgggctccgggcacacgcccctcacctgggcgaggcccggtgcgcaggcgctcagcgcgggggcagcggccgggcgcttaagcccggcgcgggcaagagttggacagttcaggggccgcgccgggccgagctgtcgcccgcgccacctccaccgccgccgctgctaccgccaccgccaccgcctgggctgcagcagatcgcgggagaacgtctgcgcgaagccccggtgcagccctggcgggaccgcagcaaccaccggagcgtgagcaacagcttcccggctggaggagccactgccccacgcgcccgcggcccgcgcgccgagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggcaaattttctacggggctttgaagaaaaggggataaagaacgacaggcctgaggaccagttgagcaaagagaaaaagaaaattcttttctccttctgtgaggtgtgcaacatccagctgaactctgcagcccaggctcaggtgcattccaacggcaaatcccaccgcaaacgagtgaagcagctgagtgatgggcagcccccaccacccgcccaggccagccccagcagcaacagcagcacaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggcccatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttgaattttctctgtaagagaataaaagataaaataatgtattttctttatttcacattttatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtacaaaaaataaaa

SEQ ID NO: 35180 - DNA, 404 bp, Homo sapiens
agggggatagctccctcatcttggatctaggggagcttataacatcttttaaaaggcgaaaattcaagttatctgtggactgtcagaacattttgcataagtcatccccagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggcaaattttctacggggctttgaagaaaaggggataaagaacgacaggcctgaggaccagttgagcaaagagaaaaagaaaattc

SEQ ID NO: 35181 - DNA, 501 bp, Homo sapiens
tagactataagcttttggaaaacagggactatgtcttcttcaacaatgtgtacacaacaagtagcaggttgtttggcacatggcagatgctcggcagtacatgccacactactacccttcctgctcttgtgcgcacacctaccctgatgatgcagccttcactggatatcaaaccatttatgtcttttccagtggacagtagttctgctgttgggctctttccaaattttaacacaaaaagaagaggcttatttgagaccaataaattttgccagatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatc

SEQ ID NO: 35182 - DNA, 565 bp, Homo sapiens
agggtgacataatggtagaacacagaacacttgtagaaatacttgaggaatgagtctgtgaggtttaatttgtgctaaaaattcatcaacacatctagagcaacgcaaatcttcccaagacagatggagactgttttaagatgttctacatttcaactccatcaaatattaaattgatgtttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgaagatggaatcatgaatatggcaaattttctacggggctttgaagaaaaggggataaagaacgacaggcctgaggaccagttgagcaaagagaaaaagaaaattcttttctccttctgtgaggtgtgcaacatccagctgaactctgcagcccaggctcaggtgcattccaacggcaaatcccaccgcaaacgagtgaagcagctgagtgatgggcagcccccaccacccgcccagg

SEQ ID NO: 35183 - DNA, 956 bp, Homo sapiens
cccagtcagttgctgctgctggtcctagggcaggctatctgtgtcgggatgccgagcattactgccactataatcactgaggcatctgccagagatctcatggctgaaaactaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacag

SEQ ID NO: 35184 - DNA, 2788 bp, Homo sapiens
agaaccggaagttgttgcgcagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactgattcaaaatatgaacatgcgattgcagaggcccaaaagaatatgtacttcaagactaggctgaagtgccccaggtcactttcaggaggcagataaataaaggccttatcttatgaaagcacacaagagcctccatactattaatatcaagttaatttcccgtgttggaaaaaaataatctcctttgcaatgtaatttggaaataagtcaatggaaacatgaaaatgactgcttgtctacaaggagtcagctaaacataaggaatgttttcataacaatattaatctatgggtgcttctgtaagatggatgatcatcttaatataaagaaaaaagggagatgaacaaaattgtcaaacaagactgatgtaccacaagtgttgtcaagtacagtgtgtgtcggagagatgtaccacagcttaactggaagaggaagcccgtaactgctgatgacaatactttcagtgtccccttttctggcataaatcaactatgaatatgtttcaagcatcacaagacaaccttttcagagtcttctgtattcttagtaagatgagtttctagacacgctgtcatgaaatgagaccctggattttgatgctcttgtacatatggacaaatcactgaagttcaatttaaagggtccactgcagtcccttataaacaattgttgaacctaaccattatagtttataagttttaagacatttatgggatatcttatttggcttatctatgggatatgagtaactatgttttacctgcatttaattcagccagattccctgtttaaaattactgaatcgtacattattaaaattattctgacagtatacaaacaacaaaattatctattttccagagattcttgataaaactctgtaatgttactacaataatacatgtattgtgttttccatggtgctacagttacacaatatggaggcaaacatcagaaatcaaagtccttggaataagggaagagactcatagtaaacttctttgtctggttgggttcctcataaagtataaaacatttcattctcagaaaatccaaccatatcttagagtatctccagaaactggcttagaggagctccaaatatgtggaattaccacactctgcttagttagtatgctgataaatgtaagattagtaggaggagaagtgaatgtaaattttattatagaattttctgatagtgattatgatttgtagctctagtgaatatgaattttatattgagttgtgtgtatcttgagtcactaaaaatgtaggatactttttatttggggctcattgtctttgtaattacggagaggaacaaaccatctattgaaacaacaagtgcctcagagatgtatatattgtgaattactgcttaattacggaaagagtttcttaggttctatgtgaataagatggcagaatctaaatcaagtattttgaaggaagcacccatcttcacttggtgctgccatcaactttgtaagattgcattctatttattgtgaataatttgagtgtttccacaggaaagtggtatgaatcatatcgtctaagtatatgatgaatctttaaagggtgtctctgtgtactttgaattattttgcagttatgtaggtatcctaatgagtgaatggtactagtttatataaaaggagaattcattgagctaaccttggttttaaaaattagcattagcacccccattatattaattttcagggatagtaaatactccaaaatg

SEQ ID NO: 35185 - DNA, 1884 bp, Homo sapiens
agaaccggaagttgttgcgcagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactggtgagaagccctacaagtgtcatgactgtggcaaagcctttagtcagagctcaaatctttttagacataggaaaagacacattagaaaaaaagtcccataagtatcatgagggaatcaaagcatttactcagagctatttcagcacaagggaagacaccagatgcaaacgctccttagtacaaatcagtggtcttagtaagcaccagtctcctttcaagactcatgaaagccacaggagagaaggttgaagatctcaggtcagcattatttgcttttctgcttatcaatgcagtctcaattctgacgtttgcaattccaaagcttaattcagatttccatccctatgcaggccttgaaaaggcattctcagacatgttctactattttcattattaacacatataatgaattagtatatatctttttagacaagtatgttttttccctcattgagaaggaatgtgtgagttactcagtgtaaaaatagacattctcctccatttcataacttgagcactagaattctaaagaccaaaaattaaagcactcaaaaagaattcctggctgggtgcggttggctcatgcctgtaatcctagcactttgggaggccgaggcaggcagattgcctgaactcaggagttcaagaccagcctggacaacacggcgaaaccccgtctctactaaaattcaaaaaattagccaggcatggcaacgtgtacctgtaatcccagctactagggaggctgaggcaggaaaattgcttgaaccgctcagacagagcaagactccgtctttaaaataaataaataaataaataaataaataaataaaaataaaaataaa

SEQ ID NO: 35186 - DNA, 1480 bp, Homo sapiens
ctgcgtacgcgcacttccggtctttgtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattaagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatc

SEQ ID NO: 35187 - DNA, 2644 bp, Homo sapiens
ctgcgtacgcgcacttccggtctttgtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattagtgagcatgaaagcaatttagtgtggaagcaaggaagtgctacaggggagaaactaagatctccttcccaagggggcagttttagtcaagtgatcttcacaaacaaatctctaggaaagagagacctttatgatgaggctgaaagatgcttgattctaactacagactctataatgtgtcagaaagttcctccagaagagagaccttatagatgtgatgtatgtgggcacagcttcaagcagcattcctctctaacacaacatcagagaatccatactggagaaaagccctataaatgtaaccagtgtgggaaggcctttagtttgaggtcctatcttattattcatcagagaattcatagtggtgagaaagcatatgaatgtagtgaatgtgggaaagctttcaatcagagctcagccctcattagacatcggaaaatccatactggtgagaaagcttgtaaatgtaatgagtgtggcaaagcattcagtcaaagttcatatctcattatacatcaaagaattcacactggtgagaaaccttatgagtgtaatgaatgtgggaaaacctttagccagagctcaaaactcattagacatcagcgaattcacacaggagagagaccctatgaatgtaatgaatgtggaaaagctttcaggcagagctcagagctgattactcatcagagaatacatagtggagagaaaccctatgaatgtagtgaatgtggaaaagctttcagtttgagctcaaaccttatcagacatcagagaattcatagtggggaggaaccttatcagtgtaatgaatgtggcaaaactttcaaaaggagctcagcccttgttcagcatcagagaattcattctggggatgaagcttatatatgtaatgaatgtgggaaggctttcaggcacagatcggtccttatgcgccatcaaagagtccacactataaagtaatttgtgaatactgtgaatagtgtaaatacttcagtcagatttttaagtttgttagtcaaaagagtttactttggagcaaaactccataaaggttataaaatactaggtcttgagtctagcttgctttgtgcagcatttcccagtgctaatgtaaagtgtcccttgaaagcttttcctgtgactaatcagaacagaatacagaagaatcattacttccagctcttctcttattaggaatactcaggaaatacgaaaagtgggaatgtaacattgaaacctcattttgtatgaaagtgtcatgaatatagcaacccaggctctgtcactgcatctgattgttagtgtgccaggttatggggctggtgtggactgtgtgaggcacttcgtctcaggaactaaaaaaaaaaaaaaaactgacccaataaagaacagtgacagagcagcaggaaaggtggggaaatggcttcatcaatgatttgttgagcccagggcaggccaggaattagataggcatgagaagaaagaatataatttacccaaaggttattttttgagtacctactttgtcccaggaactaggaatacagtggaaaacaagactgtagtctctacagtctaatgggcaaggcagccagacaggcagtgaaagtggaatgctcctatgtgaccttaaggagcacctgactcagccttggataaggaaatgggggaaatggcctgaaggatgaggaggagttagccaaggtggtactctagggaagtggtaccccagtaaagaacagtagccaaaggccagaaacaaagtgtggagcattccttgagttcctgttgtagtgaggtcttgtctgtcagagaagtctgggtctggccagactctta

SEQ ID NO: 35188 - DNA, 2162 bp, Homo sapiens
gtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagattctcattagagtattttattttgtcttgatccccaaacttcagatgaatgtggagaaactgaagcatgtccagagaaaagtggcaagatatccaaacagacagaacacagatgggatcagagggagtgagaggcttagttaaaacaaggtcaggaggctgggcacggtggctcatgcctgtaattccagcactttgggaggccgaggcgggtggataacaaggtcaggagtttgagaacagcctggccaatatggtgaaaccccatctctactaaaaatacaaaaattagccaggcgtggtggcgggtgcctgtagtcccagctactcgggaggctgaggcaggagaatcacttgaacccaggagttggaggttgtagtgagccaagatcacaccactgcactctagcttgggcgacagagccagactccatctcaaaaaaaaaaaaaaaaaaaaaaaaaaaaaaaaggtcaaagtgcagtgtactcactgcattcaagtatagattgtgttttatgaggactctgtaaactaaagaaagtggattatgaataaattaaagttgggagtatttcatatggacataaggaagaattttaatatagtatgtttactagggtttccacaacaaaataccacagaatgggtggtaaacaacagaaatctcttttctcacaattctagagactagaagtccaagatcaatgtgtcagcaggtttggtttcttctctctccttggcttgcagatgatggccaccttcttttcttgttgttgttgagatagtctcactct

SEQ ID NO: 35189 - DNA, 4297 bp, Homo sapiens
gtaagggcacccaccaggtgtaattgtgggcgagcggccgcttcggagctgacactaagcatgtgcagatcaagtccagaagcgccggggttcctcgaagcagttttcaggacttaaggctctgggacatccagcacagtgagcggcccctgggcaccaccagaaaacatttgtgagtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccata

SEQ ID NO: 35190 - DNA, 4531 bp, Homo sapiens
cggaggctccccggtagggacggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcggtcatccagcacagtgagcggcccctgggcaccaccagaaaacatttgtgagtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagcatgcaattgtatttttattttattttaaaatctttttattaaactataatgtatacagaaaatgcatatatcataaacatacagctcagtgcattctcaaaaactgaacatactcagatcaagaaacagaacatgaccagcaccccagaagccttccccactttcccttccaggcaagcccccaagggtatacattatcctggcttctcacagcatagattcattttgcctgttttgtattttatataaattgagtcaattatatatcatataattgagccata

SEQ ID NO: 35191 - DNA, 4415 bp, Homo sapiens
cggaggctccccggtagggacggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacactcccaaggagacagccatgttccttgcctgagagtcactgaaggaaattggaaagcccgcctctccttcgacgcacacgcgcacgcgcacgcacgcaccggcgcggtgtaagggcacccaccaggtgtaattgtgggcgagcggccgcttcggagctgacactaagcatgtgcagatcaagtccagaagcgccggggttcctcgaagcagttttcaggacttaaggctctgggacatccagcacagtgagcggcccctgggcaccaccagaaaacatttgtgagtgaacgtggagtgatgaccatgtggacactgtctttccagggtttcttggagcctctgcagagtctgggggccaggcttcttagtggaaactgcaggatcttccttctgacccctgcttgcctcgccccagcagctccggttgagtccacagatgccagctcagcttccagcttggggaagagtggggttgtcagcaggagagcctgagggctgaggcccagcgtgaacatggcagctaatggggactctcccccatggtccccggccctggctgcagagggacgtggcagctcatgtgagtgctgaccatgctgccttgaacagcattgtgtcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaacataaaaacattgaaaaaataattcatgtgactaccaagcttgttccttcaattaaaagactccataactgtgacacaattttgaagcatactttaaactcacataatcataatagaaacagtgcaacaaagaaccttggcaagatttttggaaatggtaacaatttcccccatagcccttcctctactaagaatgagaatgctaaaacaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactgagaaagtcttcacctggaaatcacaactgggtatgcatcaggtatctaatagcagggaggaggaaggcctgttgctgcaatcattgtacagggggaaatgggtatgagagactgaggcttgagtgaactgaaggcaaacagagccaagtatccttcagtccactggaaagacaagttcctgcatcaccacagtgtatatgcaattctatgcataggaagagcctttagagaaagcatttgagcgaaagtcatgtttggtgacatgattcatacagacctcttgagctcctggaaatagtagaattaagacctgaggagatgactcgtcatctcttatgcttcactttttggataaagaactttttaaattcagtactgattggttcagcatatcctgggacataaaaatactcactactgggaaaaactttttcaaatttctaggttgaggagaagagttttcattgtccaaacactggcagggcactgacatcaaggcagaaaacctacttgggaatgcagatatctgtttttgtgatcattggcacttaagacatagaaaagatttccatgaaaaacttttttcttttcccttgggaagtcctcatggtatatatattttaagtgcaatggaatttttaaatttaaagatataactttatgaattgagaaattaggcctagctctaggctatgttacagaaatatagtcattgaatgatacagacatataaaggtagtagttgtctcattattaattccctgctgggagagcagatgagtcataccctataagaagtatgcatgccttctaacctatgtccccaaagctgtcatttgcataagctgcaggccatagattcctgattccctcagtaactgaccctacgacaatggaactgatccacggcactctagattttcaggctaacccaccaacacccctgctttccttgggatttcctgaaaaagaatggttgaaaaattgagtttcacttcctaatattttgtttttcttcctatttggttaaggtatattcatttcctacatgcacattaagggtagttttgtgtagactgctatgtgataaagtcatgttgcattgcaattagttattctaagacataattacagtttatcatagttgaataactggaagacttctcaagaaagagcactgctcttttttaacactgatatatagacacgttctcattttcccttaaacattttttacaatactcataaaaaggaactttctttctagca

SEQ ID NO: 35192 - DNA, 613 bp, Homo sapiens
agcttccagcttggggaagagtggggttgtcagcaggagagcctgagggctgaggcccagcgtgaacatggcagctaatggggactctcccccatggtccccggccctggctgcagagggacgtggcagctcatgtgagtgctgaccatgctgccttgaacagcattgtgtcgttacaggcttcagtgtcatttgaggacgtgactgtggacttcagcaaggaggagtggcagcacttggaccctgcccagagacgcctgtactgggatgtgacactagagaactacagccacctgctctcagtggggtaccaaattcccaagtcagaggctgccttcaagttggagcaaggagaggggccatggatgctggagggggaagccccacatcagagctgttcaggtgaggctattgggaaaatgcagcaacagggaattcctggaggaattttcttccactgtgagagatttgatcaacccataggagaagattcattatgttctattttagaagaactgtggcaagataatgaccagctagagcaacgtcaggaaaaccagaataaccttttaagtcatgtgaaagtattgattaaggagaggggctatgaaca

SEQ ID NO: 35193 - DNA, 4817 bp, Homo sapiens
gaaaatcaaaccctccggaatgtccccctgaagaggaccactgttgcagcggggaccctcctttcaggcatcctcattttatcatgtccctttgctttcttccccagtggccttttcaaaggtcagagagaaatgcttagtcaaacccctacttgagtatcacaggtgactaattttgggatcgaagattaaggaggttttgttgcgtccttaaagaacttggaattggagtccaggtagttttggaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcg

SEQ ID NO: 35194 - DNA, 4201 bp, Homo sapiens
accagtgggccggtgggaagcgcctctccagccctcgcctgccctgccgccgggtgctgggaacccgggctcaggttctggccctcttggcatcggccagtttgccctgggacgccctggtgagcagggggaaagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatattt

SEQ ID NO: 35195 - DNA, 7660 bp, Homo sapiens
ggaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagcatccggctgcctggttctctcctccccagcctagggccgcgtggggggctgtcagctcctgtaaggtgtgttcccctacaagttcctgtgggcttgcacacgcccttggggacctgcacacaatagaccctgctccccttggaaaagaatcgtagtaacctaatgcatgcagactggacaggctggcagtggccacaggagtcaaagcagaagaccccttaatgatggaataccctgatcttcccactcttggatggggaaacagaggcccaagggtaacgtgcagctttcccaaggccacgcagcaggttggtcaccatgctgattgtgaagtcttcttggctttcccttcagggttggctttcccctttgttggatacaggcaggcaagtgggtagcccttcccttgccaggactccaggtggcacttgggttctgaggcacggagatgtgtgactggggactgcagagcagagccaggtaggagccgcaggttcccagtcatagagatcagtaggatgtgagagcattgagactggtggcgggggccaggtctggagtgaggcaggcaggggcctggggtacattatttcagggggcactcgctctcagggcccccctacacctgcaagtgctgggaatgggtgtcctcttgcattttacactctaggcaccttgcttatttcacctactcctggccctgctggcctcccagggcccacccagcagccttggtctccaggcctcctccatgttacctcccacacctccatcatgctggtgctcagctgacttgccaatcagaggccagaacttgcacggggaaacccttccttgctaacttttcacaaggggcaaggaaattggttattaccctctgcagagcggaaatgaaacaggcagacagattgcacctaattataatgtaatactaagtcacgggtgtggaatttggagcaattatacccatcatcttctagaagactcccatatcaaggggcttctggtgacctataagagttcccctttctttctgtcacctcatgtaatgttctcacgcgggtggggctttcagtttttcaaaaggcatcttacatatgtgaatcatagagcagaccctgccagtagtgggctgttgcctcctggaaactgaaggctgtgaatgccaattttcagcctcctggagacctggcagttttgggggaagaccccagggtagacaccagtgttcctctaagtgtgcccacccgtggactggggcttggggcctggggctggggctatgtctgagtgaggctgccacacatccacagccaggcctaccttttgggcagtgctgggactgtcgatgggaccagtatgtcccggggcctgccacatctccgtctcagggccctctccagctctggatttatcccaaaccccatggagcccaggtgagccctcagtaactaccaatagaagattcgatttgacggttggtggcgtagggctaaattagtcactgcccccattaaaaatacagcggggggtttaagagcttttcacgccatgtgggaatcagcagcgaagccggctgatgccttgggtaaggagagaggcggcctaggggaccgtgaggtaatgaggtttatggcggtgacaaggcagccagggaaccccaccgactcccccctcaccccggccgcattgttctccggctggctctgtccctgctgctacggctgagagcccctcgtgactttgtgtggggagggggctggcagtggggaccctgaggcccttcctgggactggcattctttaccatcaggtggtattagggttggggagcagtgtagggttataaacctgtgcctcggagaactcactaaccccttccagaggaaaggtctggagctgggatgagacacttgcctttcaactgtgaggggccttagagggtctctgggaggcttgtatgaagtgatgcctgacaaagggctgcacacagagacctgtaagcagcatggtcatcaatgatggtgccaggcatcctgcaggagggcaccttttcagccaggagggcgcgatggaatcagcctctcatttggatttggctttggggagtgggcgaggtgactgaaagcctaaggttcattgctgctgtatttagatgtacaaattgtcagtttctagcggctctctgggcagaggaattttgcccaggctgggaaatggaccaggacccttgggccacaggcccctgtcatggaacacctgcccagagtgcccagaagcaggcaggtaagggtttcagtctcagtggagaaactgtcatgggagaaatcttctcgagttccccagccttaaagaacgctccttttaaattcacagttgtgtaatattgaacttttcacctgtttttcttccctcctaaggtgtgtgttcctagggatggaacctgtacctataaatattcagtaaataggaccaaaactcaaatccatcccttcctctactcatccattcagcaagtatttactgagctgcccccaggtgccaggcactgcacagggcactggggataaggagatgaccagcagatgtggtccctggcctcatggaggccacagtggcacaggcaagcatgccagtaaatgcatagccacacctggtcatgagtgccgtgatggcaaagccagaagctgccagggattaatggagggacccgtgtatgagacacaggggtgcattaaggaaggccttgctgaggcaggggcttgagacctgaagaaataagggaggtgggcagtccaagagcagtgggaagagaacactgcaaatgcagaagccgtgagctggaaacgagccagaagtacccttagagagctgtattcctatggagtttcaattctaggtggcttaaaacaatcccagagaagttcagaatcttgtccaagatcataccattcaggatagacttgcgactataacttgggtgcctcaccttccagcctggggtgtctgactccattgttaattttattataacaatcatgatgacaacgatgaataaagtgaaattgtactgtacaggaaa

SEQ ID NO: 35196 - DNA, 2848 bp, Homo sapiens
gctgcagttggagctctgcgtctcgtcttcgttcttctgtgtcctctgctgctagaggtccagcctctgtggctctgtgacctgcgggtattgggggatccacagctaagacgccaggaccccccggaagcctagaaatgggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaa

SEQ ID NO: 35197 - DNA, 3397 bp, Homo sapiens
cttttccgcgttctccaactcgggaatccccggtgactttgtcgcagcctccgttaccctgtgatctgcaagtcctgggagacgcacagctaagatgcccggacatcctggaagctgggaaatggtgggttggttactctcagaccaagattcagtacacatgtgaggctgtgactgcactgaaaagcacagtccgcagacaaaattgtggctctcttgcaataccgtcaaccattgagattgtgactcacgtacttagacagacccaacatacaggaggtgttgaccctcatacctggaacctggacatgtgtggaatttctaatctcattcctggactttcctgcaggtgatgtgactcttcttcagcctgcaccctgccaaaagaggattgtgatgtatcactggacccagcacctagatgacgtaactctcatcttttgcctggaccttgcatattttgggtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtg

SEQ ID NO: 35198 - DNA, 5584 bp, Homo sapiens
tctccaactcgggaatccccggtgactttgtcgcagcctccgttaccctgtgatctgcaagtcctgggagacgcacagctaagatgcccggacatcctggaagctgggaaatgacagacccaacatacaggaggtgttgaccctcatacctggaacctggacatgtgtggaatttctaatctcattcctggactttcctgcaggtgatgtgactcttcttcagcctgcaccctgccaaaagaggattgtgatgtatcactggacccagcacctagatgacgtaactctcatcttttgcctggaccttgcatattttgggtgtgattgtgacacatacctctgctcagaatgtgagcgatttgactctcctgcctgggcccagtacacagatgggattgtgacatatcgctggacccagcatgtagatcatgtgaccctatactcttgccttggtgctgtcgcagagggcattgtgacatatcactggtccctgcacccagggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctataatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatgaa

SEQ ID NO: 35199 - DNA, 3919 bp, Homo sapiens
agcggacagggcggcttccgggtttggcggggcctttgtccctcgctgtggcctgagctccaggtctcgtcttcagcgctctgtgtcctctgctcctagaggtccaggctctgtggccctgtgacccgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccagttacatattctcattttgcccaagacctttggccagagcagggcataaaagattctttccaagaagtcatattgagaagatatggaaaatgtggacatgaagatttacagttaagaacaggctgtaaaagtgtggatgagtgtaatctgcacaaagaatgttatgatgaactaaaccagtgtttgacaactacccagagtgaaatatttcaatatgataaatatgtgaatgtcttttataaattttcaaatccaaatatacaaaagataagacatactggaaagaagcctttcaaatgtaaaaaatgtgacaaatcgttttgcatgcttttacacctaactcaacataaaagaattcatattagggaaaattcttaccaatgtgaagaatgtggtaaagtctttaactggttctcaacccttactagacacagaagaattcatactggagagaaaccctacaaatgtgaacaatgtggcaaagcttttaagcagtcctcaacccttactacacataagataattcatactggagagaaaccctacagatgtgaagaatgtggcaaaacctttaaccggtcctcacaccttactacacataaaagaattcatactggagagaaaccctacagatgtgaagaatgtggcagagcttttaaccggtcctcacaccttactacacataagattattcatactggagagaaaccctacaaatgtgaagaatgtggcaaagcttttaaccaatcctcaacccttactacacataagataattcatgctggagagaaaccttacaaatgtgaagaatgtggcaaagctttttaccgattctcataccttactaaacataagataattcatactggagagaaattctacaaatgtgaagaatgtggcaaaggctttaattggtcctcgacccttactaaacataaaagaattcatactggagagaaaccctacaaatgtgaacaatgtggcaaagcttttaatgagtcctcaaaccttactgcacataagataattcatactggagagaaaccctacaaatgtgaagaatgtggcaaagcctttaaccggtccccaaaacttactgcacataaggtaattcattctggagagaaaccctacaaatgtgaagaatgtggcaaagcttttaaccaattctcaaaccttactaaacataagataactcatattggagatacatcttacaaatacctagaatgtgataaagcctttagccagtcttcaactcttactaaacataaggtaattcatactggagagaaaccctacaactgtgaagaatacggcaaagctttcaaccagtcctcaaaccttattgaacaaagtaattcatactggagagaaaccctacaaatgtgaagattgtggcaaagcctctaacccgtcctgaattcttactaaacataagaacattcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagtgagctgagatcgcgccattgcactccagcctgggcaacaagagtggcactccatctcagaaaaaaaaaaaaaagataattcatactgaaaagaaactctacaaacttgaaagatgtgacagtgcttttgacaacacctaaaacttttaaacataaaaaatcatactggtgagaaatcctagaaatgtaaagaatgtgacaaggcctttaaatggttgtcacacttcattataggtaagatagttcatactgaagaaaacttctacaagtgtgaacagtgtggcaaaacttttaatgaatgctcacaccttattgcacaggagagcatttatacttgaaaaaaattgtacaaatataaagaccatgaaaaagccattaatatctattcacatcttaccactggagagttcatacttaataaaaggaatataagtgcaattactgtcaaaagatctttcagaaaatataaacctttaaagcgaagaaggtatttattttgaagatgaacactacaaatgtgaagagggttgtagtacctttatttgtatcacagattttattgtacacattttgtactagaagaaaactctgaagtagttgctcaaactttgttcaacatcagggaatttatattgaagaaaaactttgcaaatttaataaattttaaaaaacactttttcaaaaagtacagcttagaagacaccagagttcatactaaaatatatttttgcagatgcagtaaaaatgaaaatatttaatccaaaattaagtctatgtaaatatcagagaatttactgtagaaatatataaggcactgagacttcagatattatactaaatcagagtgctgagtatagaaaataaaactgaagttggggccaggtgcagtggctcacacctgtaatccagcactttgggaggccgagaagggtggatcacctgaggtcaggagtttgagaccagcctgactaacatggagaaaacacggctctactaaaaatacaaaattagccagctgtggtggtgtatgcctgtaatcacagctactcgagaggctgaggcaggagaattgcttgaacccgggaggtggagagtgcagtgaactgaaattgcgccattgcactccagcctgggcaacaagagtgaaactccatttcaaaaaaaaaaaaaaaaaaacaactaaagttggtagaaaaattatttgtatataactttaaaaggagtagaagggctttttgcagagttattacgtttgaagtatactttatttcttgaaaaaattacagattttttgtaaataatgatgtaattcaactctcaaaatatttcctactgtttctttattccagttgtattcacatgtgaaagcatgtgatcagttattgctgcattaaaaacatgagtcttttttattaggtggccattatttatgatcttttctatgaaagagtaaggacattaaaatgtaagatgcatgatgaaaaattaagtgaagaggctctttatggttaatttatattgaataatgcattaggtaggtgttcagagtaatattttgcgttgtgagaacatttttaattttatttaaaattaaatgaaaataaattagtatattattgtactaattgtacttttgtataataaaatccagtgtatttta

SEQ ID NO: 35200 - DNA, 4071 bp, Homo sapiens
gctgcggctctggaacccgttcgcggtctctcaggttttggagacgacgatctagtggatcttttgcgggacaggagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaatttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtgagccactatgggtatcagcttgggagtggccatagatgaccgcatttccatgacctaactgtatttcacccccttttccttccctactgttcttgccccaccccaaccagttcctgctgctgcttttggcttcttggaggtgaagggcttaaaacaaggcttctaagcacccagctatctccatacatgaacaatctagctgggaaacttaagggacaagggccacaccagctgtctcctctttctgccaattgttgcccgtttgctgtgttgaactttgtatagaactcatgcatcagactcccttcactaatgctttttgcatgccttctgctcccaagtccctggctgcctctgcacatcccgtgaacactttgtgcctgttttctatggttgtggagaattaatgaacaaatcaatatgtagaacagttttccttatggtattggtcacagttatcctagtgtttgtattattctaacaatattctataattaaaaatataatttttaaagtca

SEQ ID NO: 35201 - DNA, 3788 bp, Homo sapiens
gccggaaaggacccggcctcgagatggcagagcggaggcgttccctgggctgagctgagcacctcctccctgagacagcagcggtctaacccccggcgcgggagggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaatttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgtt

SEQ ID NO: 35202 - DNA, 3237 bp, Homo sapiens
gctgagctgagcacctcctccctgagacagcagcggtctaacccccggcgcgggagggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttg

SEQ ID NO: 35203 - DNA, 2119 bp, Homo sapiens
aattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaa

SEQ ID NO: 35204 - DNA, 2706 bp, Homo sapiens
ctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacggaaaaaaaaaaaaatagccaggcatagttgctcacacctgtagtcctagctactcaggaggctgaggcaggagaatcccttgaacccgggaggtggaggttgcagtgagccgagattgcactactgcactccagcttgggtgctagagcgagactccatctcaaaaaaaaaaaaaaaagtttccatttctttcaaatagagttgctgcctgctatatgcaagaagattggttccagtacaccctgagtatacctaaatccacagatgccagctcttttataaaatggaatattcgcatgtacctacccacattctcctgtatactctataaatgtctagattaattaaaatatctcatgcattgt

SEQ ID NO: 35205 - DNA, 3236 bp, Homo sapiens
actgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgactcagtgacctttgaagatgtggctgtgaacttcacccaggaggaatggactttgctggatccttcacagaaaaaactctacagagacgtgatgtgggaaaccttcaggaacctggccactataggaacaaaacaaaaagaatggaacattgaagagcagtacaaaaaccaggggagaaatctcagaaatcatatggtagagagactctgtgaaagtaaagaaggtagtcatggcggagaaggtttcagccagattgcaaatctcagtctgaacaagaaaactccttctggaggaaagctttgggaaagcagtgtatgtggaaaagtcttgagccatcattcatcccttaacaggcacattagatcttacaccagacacaaactgtataagtgtcaggaatatggagagaagccatataaatgtaagaaatgtgggaaacccttcagttatctgcagtcttttaaaaaacataaaagaacacacagtgcagggatagtctacaaatgtaaggcctgtgggaaagccttcagttgtcaacgttctttccaaatacatggaaggactcacactggagataaaccctttaagtgtaaagaatgtggaaaagcattccgataccaccaatctgctcaaaaacatgaaaaggctcatactggagagaaaccctacaaatgtaaggaatgtgggaaacccttcatttaccgccattctgctcgagcacatgaaaggaatcacactgtacagaaacgctatgaatgtaaacaatgtggaaaaacctacatatcttctgtaggttttcaagcacatgaaagaactcacactggagaaaaaccctatgaatgtaaaaaatgtgggaaagtgttcgtatatcacaactctgctcaaagacatgaaaagactcatactggagagaaaccctacaaatgcaaggaatgtgggaaagccttcagttaccactgtactgctcaaaaacatgagaggaatcacactgcacagaaacactatgaatgtaaactgtgtgggaaaacttacttgtctcctttaggttttcaagcacatgaaagtactcacactggagataaaccctttgagtgtaaaaaatgtggaaaagcatttagatactactactcagctcaaagacatgaaaggactcatactggagagaaaccctacaaatgtaaggaatgtgggaaagccttttattgttgcagttctgcccga

SEQ ID NO: 35206 - DNA, 2372 bp, Homo sapiens
tggcctcttcaccctggtgacctctgttccgtattctgtcactgagagacgccctgggacatctgtggtggcttttgtcgcgctgggacctaccctgactacgggagttgggaggacccgggacaccgcacagccgggaaatggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgactcagtgacctttgaagatgtggctgtgaacttcacccaggaggaatggactttgctggatccttcacagaaaaaactctacagagacgtgatgtgggaaaccttcaggaacctggccactataggaacaaaacaaaaagaatggaacattgaagagcagtacaaaaaccaggggagaaatctcagaaatcatatggtagagagactctgtgaaagtaaagaaggtagtcatggcggagaaggtttcagccagattgcaaatctcagtctgaacaagaaaactccttctggaggaaagctttgggaaagcagtgtatgtggaaaagtcttgagccatcattcatcccttaacaggcacattagatcttacaccagacacaaactgtataagtgtcaggaatatggagagaagccatataaatgtaagaaatgtgggaaacccttcagttatctgcagtcttt

SEQ ID NO: 35207 - DNA, 1623 bp, Homo sapiens
atgggaatagtagaaaaagcttctagttcttcagactcagtgacctttgaagatgtggctgtgaacttcacccaggaggaatggactttgctggatccttcacagaaaaaactctacagagacgtgatgtgggaaaccttcaggaacctggccactataggaacaaaacaaaaagaatggaacattgaagagcagtacaaaaaccaggggagaaatctcagaaatcatatggtagagagactctgtgaaagtaaagaaggtagtcatggcggagaaggtttcagccagattgcaaatctcagtctgaacaagaaaactccttctggaggaaagctttgggaaagcagtgtatgtggaaaagtcttgagccatcattcatcccttaacaggcacattagatcttacaccagacacaaactgtataagtgtcaggaatatggagagaagccatataaatgtaagaaatgtgggaaacccttcagttatctgcagtcttttaaaaaacataaaagaacacacagtgcagggatagtctacaaatgtaaggcctgtgggaaagccttcagttgtcaacgttctttccaaatacatggaaggactcacactggagataaaccctttaagtgtaaagaatgtggaaaagcattccgataccaccaatctgctcaaaaacatgaaaaggctcatactggagagaaaccctacaaatgtaaggaatgtgggaaacccttcatttaccgccattctgctcgagcacatgaaaggaatcacactgtacagaaacgctatgaatgtaaacaatgtggaaaaacctacatatcttctgtaggttttcaagcacatgaaagaactcacactggagaaaaaccctatgaatgtaaaaaatgtgggaaagtgttcgtatatcacaactctgctcaaagacatgaaaagactcatactggagagaaaccctacaaatgcaaggaatgtgggaaagccttcagttaccactgtactgctcaaaaacatgagaggaatcacactgcacagaaacactatgaatgtaaactgtgtgggaaaacttacttgtctcctttaggttttcaagcacatgaaagtactcacactggagataaaccctttgagtgtaaaaaatgtggaaaagcatttagatactactactcagctcaaagacatgaaaggactcatactggagagaaaccctacaaatgtaaggaatgtgggaaagccttttattgttgcagttctgcccgaagacatgaaaggatgcacactgcaaagaaacagtatgaatgtaaaaaatgtgggaaaacatacattactcttgcaggtttccagatacatgaaagaacccacactggagagaaaccttatgaatgtaaacagtgtggtaaagccttcagtagttccagttatattcatatacatgaacgaattcatactggagagaaaccctatgaatgtaaagaatgtggaaaacccttcagtttccttacaggctttcgagtgcacatgagaatgcacactggagagaaaccttataaatgtaaggattgtggcaacgccttcatttggcgtgcatccttacaataccatgtgaagaaagtgcacgctgaatag

SEQ ID NO: 35208 - DNA, 2443 bp, Homo sapiens
atggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagatatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacggaaaaaaaaaaaaatagccaggcatagttgctcacacctgtagtcctagctactcaggaggctgaggcaggagaatcccttgaacccgggaggtggaggttgcagtgagccgagattgcactactgcactccagcttgggtgctagagcgagactccatctcaaaaaaaaaaaaaaaagtttccatttctttcaaatagagttgctgcctgctatatgcaagaagattggttccagtacaccctgagtatacctaaatccacagatgccagctcttttataaaatggaatattcgcatgtacctacccacattctcctgtatactctataaatgtctagattaattaaaatatctcatgcattgt

SEQ ID NO: 35209 - DNA, 2042 bp, Homo sapiens
cggggcttcatggggagttgttgggctgaacgagcggctcggagtatgggattgggggagggggacgggggagtttggcgcaaagcctgctggggcatggagtcccggcgagctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccgg

SEQ ID NO: 35210 - DNA, 3773 bp, Homo sapiens
agttgccggtgagcttgggagaaccgtgggcgctgaggcgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggttgatatgcatgacatgctcttggaagaactggcaccagtgggaacggcacacataccaccaaccatgcacctagagtcacctgcactccaggtaatgggacctgcccaggaggccccagtagcagaggcatggatcccacaggcagggccaccggagctgaactatggtgctactggagaatgtcagaactttctggaccctggatatccattaccaaaacttgacatgaacttctcattggagaatagagaagagccatgggtgaaggaattacaggattctaaagaaatgaaacaattacttgattccaagataggttttgagatcgggatagaaaatgaagaagatacttcaaaacagaaaaaaatggagactatgtatccatttattgtaactttagaggggaatgctctccagggtcccattttgcaaaaagactatgtacagttagaaaatcaatgggaaacccccccagaggatttacagacagatttagcaaaactggtagatcagcagaaccccactctgggagagacacctgagaactccaacttggaagaacctctcaaccctaaaccccacaagaaaaagagtccaggagagaaacctcaccgatgtcctcagtgtggaaaatgttttgctcggaagtcacaacttactgggcatcagagaattcattcaggagaagaacctcacaaatgccctgaatgtgggaaaagattccttcgtagttcagacctttatagacaccaacgacttcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaagtgtactcattgttctaaaagcttcagacagagagccggccttattatgcaccaggtcactcactttagaggacttatttaagaattgctaagggaaacaggtcttacacaaattgacactaactcaaaaaaaatcttaacctgcagcaggctgtttgtcttggaagcttttgtttgagcttataagaacatagacagcttttttttttactagttttaaaacccatcttccaaggtatatgaattctagagtatttatctactcctgtgattttcttagatttgatttcttctgtctgcacaactcttctttttttaattacaatgaaaaattttgtgttccaaggcaactgtatcataggtgtaaacataaagcatataaattatgacaatccttttagaggtagggtcaatatagtggataaacctgtctatcagacgtattgattatagcagtactatagttattctgctgtcattattaaagatgattatattcattcaaagctttagatgtgtcccatgtggcaagaaaggagacagtgaattttgtcaaacaataaaaatgtgtcaggaacacaaggatgaaggggatgtcatttgcctggtaagaactgggttatttccactgaaatttgttatgtttaaggaaattaagattttaagcttgaaattatacaagcagaatctaatttaattttgattgactgaagaaccagggtcttttgctctcctttggtatttcactctcctttggtattcaatcatgtgtcttttagtgctttttaaaattttacccattctttaattcagcatctccctatgtatgtgtcatagaatacttagttctgctagatattctgcaaatatatttgggaattacttcctgctgtttcgccttcttaggttcatagtacacatcagcatatgagaatctctgagaggtcctctagaaaggagagaaaaagcacctcttttggctcaatgttttccaaacttatttgaccccaaaacctttttcatatacccaataataagctacagaactaatattctgcaaatgtctcttggaacacactgccttaaacagatatttctatagctgtcagtatagttatgttgctcccaagcctagttatctccagttgttttaagggtgttatgaaaaattcttaaaatatatatgaatttgtgtaacacacacagagacacacacacatactactttaagggggtgaggatcattaattcagataatttttaagtttcctagtgattctcaatctctttgaattttacttacatttacacacacacgcacacacatatgtatatacacatatcattttaagaagctgaggatcactaattcagataatgtataagtttcccagtgattctcaacctctttgaattttacttataattacatacacacacacactgctacttatataaatgttctcatgtaatcatggtaacagctcaaattcccaaagcaagggaagacttctcattgtcagttaaacctgttaaaacatgaaaatattcattgagcctagttccttgttataaaatacaagaaataagacattcaggcattttccctttatgaagatgttcagtcatcctttccttgaactacaattaggaaaagtatatgtctttattccattgaagttctcgagagtgatataaatactttggggggtatctactatgtgcctaactagtcctgttctaggcttagtggaagctagtaaagaaatataattcatggatcaggctcataaagattttataatatttttagttaaacaagagttgggaaacaggtggagaataatgcaagagagtttgtaattaagtgccaattataccaattgctagacccaggatgtatctttaattcttgtcatccaggtcaacatatgatgctgctataagtctggggctcaaattgatatcccagtagcaataaacatataatataggaggagtctgaatgtagagatgaaaaatacagaatgtaatggcttctcttttctctcttgtggaattgcattcaaaccagaacagtgccttagaatggatgtgcccaactgctctgtatttatgcaatatttgaataaagcggaaatgtatgtgctcttcctgc

SEQ ID NO: 35211 - DNA, 524 bp, Homo sapiens
agttgccggtgagcttgggagaaccgtgggcgctgaggcgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcagacatttgctgctgaatacagtcactactag

SEQ ID NO: 35212 - DNA, 2051 bp, Homo sapiens
agttgccggtgagcttgggagaaccgtgggcgctgaggcgctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttccaaaatggcatacgactctaggtaaatctgaacaataagcagtgtagtctttgcttttcacattagtgcattcctagaaaatttcatttgtgctgaaactatgcaaaacaaaacaaacaattgtacttatttgaccaacaaggtggggttcttgacaggttctttttactcacatgaatgtttgagtgggacattccacacttggtagggacctagaacaattctgcattgtaaattatgttccattaaattctgatagccaccacctgtcagcatatccaaaactccccatggggacagtggcactgtctgccattcagaatgactgtgtaaagcctcttttcagaagtgccgtgactgagagagggcagtatctttgggaaaagggagcaggagcttccagatgggcatcagggatactccagtcttgtctatgggggttctctgcaggagctgttagcttcagggctcctgaacaggagtcttctgaagttttctgtctccctagggtacttgggttggtggttgcccttcctttctctgtctccttggttttgtttactatataagattttatcttcatgtggtctagacatttgctgctgaatacagtcactactagtcatgtacagctcttgagcccttgaaatatggccaatacaaattgagatctgctgtaagtatgaaatacacaccacatgcagaagacttggtatgaaaaaagtaggtgaaatatctcactaataattgttcatattgattacatgttgaaatcctgattgtttgcactggattaagtaacacgtactattaagattggccttactttttaaaaaatttattcatatggccactagaaaatttaaaa

SEQ ID NO: 35213 - DNA, 3903 bp, Homo sapiens
gagagcgcggccttcattcctctcgtggaagtgagtgagtcctgggaccccgcgacctgttttaacttttatggtttggtcgtaggatcagcagggctcgcacttcggtcagcaggaaaagacgctgcggcgagcagcggagggcggagttgaatggctgggcagctgattgccttactgtatccggagctgctgcgttcggggcggttcgggagtcccctggttggaagtggacctgaatggggaggcgtctgaggatctcctgggctctcagcggcccgacccgccttcccccacctcccacagctctgtagcttcctagcggtgtaacgttgggaaaggaggctgttcttggactatgcctgacccgttttttaagaaagagtgcatcactcaacaggtggcgtctggagttatcctctgtggattttccaggatctcagacaagatcgtgcaatctcccagcctcctttccttcccctgccctgacttctgaaagaatgctgcgggagaggaggaaggagagcatcctggcttctggcagcagagccccactgtgacaggacctagcattcaccttcctcttctgttccgagtgcgagaagacttcagggacctctgtttcatggacattatcatattcttctcaagagtacccagcaagaggtttgcaaagaggagttattcagtgaaatcagaatcataccctgagagctacaagaactccatttttcactgtgcagaggctctctgctgaagggtcaagtggaatctggaatccagcccatgtttccccatcatcaagccatgtgaagctgcagactccaagcaacagagagacaagatttagaatactggctctggtatgaaagctggattcaggtactgttcctgcctcttgacctcaccaagcctcagcttcctcgcctgttaaatggatacaattgtcgtcattatcatctgttgagaactccctaaaatgccagctgagcataggcacagaagtttaggtgtttggaccaaggtcacacaactgatacaacagtagcttcttcacagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcatgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacaggggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattctgttccactagaatataagatccaagagggcagggactttgttgactgccaaatctactctgccttttcagtgcctaatacgttgtaatttttcagtagtatttgaaattactgtcatatttgaaattcagtaatatttgacatttttatttatctctagaagtttctctaaaattgtactcagaagaattctgcaaggcttggaggatatataagttagtcatatggcctgattttcccatttttgcagatctcgtggacaagtgtttatcaaactgaaggttgcagcttgttagtgggttcagaaatcagtttctggctagcaactagaagttttgtatgttaacagtactttattgaggtgtaatctgcatgcagtaacatgcacaagtctcaagttcatggctttctgaattttgacaaatgtaatcatcaccaagatcaatgtatacaatatgtctattaaaccaaaaagttttcttgtgcccatttccagtcaatccca

SEQ ID NO: 35214 - DNA, 3895 bp, Homo sapiens
gagagcgcggccttcattcctctcgtggaagtgagtgagtcctgggaccccgcgacctgttttaacttttatggtttggtcgtaggatcagcagggctcgcacttcggtcagcaggaaaagacgctgcggcgagcagcggagggcggagttgaatggctgggcagctgattgccttactgtatccggagctgctgcgttcggggcggttcgggagtcccctggttggaagtggacctgaatggggaggcgtctgaggatctcctgggctctcagcggcccgacccgccttcccccacctcccacagctctgtagcttcctagcggtgtaacgttgggaaaggaggctgttcttggactatgcctgacccgttttttaagaaagagtgcatcactcaacaggtggcgtctggagttatcctctgtggattttccaggatctcagacaagatcgtgcaatctcccagcctcctttccttcccctgccctgacttctgaaagaatgctgcgggagaggaggaaggagagcatcctggcttctggcagcagagccccactgtgacaggacctagcattcaccttcctcttctgttccgagtgcgagaagacttcagggacctctgtttcatggacattatcatattcttctcaagagtacccagcaagaggtttgcaaagaggagttattcagtgaaatcagaatcataccctgagagctacaagaactccatttttcactgtgcagaggctctctgctgaagggtcaagtggaatctggaatccagcccatgtttccccatcatcaagccatgtgaagctgcagactccaagcaacagagagacaagatttagaatactggctctggtatgaaagctggattcaggtactgttcctgcctcttgacctcaccaagcctcagcttcctcgcctgttaaatggatacaattgtcgtcattatcatctgttgagaactccctaaaatgccagctgagcataggcacagaagtttaggtgtttggaccaaggtcacacaactgatacaacagtagcttcttcacagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcatgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacagggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattctgttccactagaatataagatccaagagggcagggactttgttgactgccaaatctactctgccttttcagtgcctaatacgttgtaatttttcagtagtatttgaaattactgtcatatttgaaattcagtaatatttgacatttttatttatctctagaagtttctctaaaattgtactcagaagaattctgcaaggcttggaggatatataagttagtcatatggcctgattttcccatttttgcagatctcgtggacaagtgtttatcaaactgaaggttgcagcttgttagtgggttcagaaatcagtttctggctagcaactagaagttttgtatgttaacagtactttattgaggtgtaatctgcatgcagtaacatgcacaagtctcaagttcatggctttctgaattttgacaaatgtaatcatcaccaagatcaatgtatacaatatgtctattaaaccaaaaagttttcttgtgcccatttccagtc

SEQ ID NO: 35215 - DNA, 3849 bp, Homo sapiens
gaaacagtgtggggcctagagcgctgggtgggcgcgttctgcggcctgagcagggacgggtagtgaagcggttacgccccttcttcgcgtcttggcgggagcctgacgccccgcttctcccctaacgaggtgtcccaccggcgcccgccgaggcctaggcctccgcagccgccctccgtctcctcagccccgacgctgcgccttgggccttgtgcgcatttttttcgggggaaaactgaggctcggagtgcgaaagtcagccgaggtcgccccgcccaggacagagaagggctgtggtcggctgatccgcggcattcccgggatggcggcggcgtggatggctccggcgcaggagtctgtgaccttcgaggatgtggctgtgacatttacccaggaggagtgggggcagttggacgtgacccagagggccttgtacgtggaggtgatgctggagacctgtgggcttctggtcgcactgggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtgggaaagacttcaaccgcaggtcacacctcacacggcaccagcggactcacaatggagataagccctttgtgtgcagtgaatgtggaaggaccttcaatcgcgggtcgcaccttacacggcaccagcgggttcacagtggagagaagccttttgtgtgcaatgaatgtggaaaggcctttacctaccgctccaattttgtcttgcataacaagagccacaatgagaagaaacccttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaatcagggtaattagcatatccatctcaatcatttatcatttctttgtgtttagaaacattcacagtctgcttttctagctatttgaaaatataaaatgtattattgccaattgtactcattctgcagtgccacagaacactacaacttattcaaatggaatcttacttgctgtaattttgtatttgttaaccaatctctatctgcctctctgctgtccttcccagcctctggttaccaccattctcaaccttttatgcttgcatatgagtagaaacatggagtatttctctttctgtgtctagcttatttcacttaatgtctttcaagctcattcatgttgctgtgaatgacaggtttatttttcatggctgagtagtattccattgtgtatatatgccatgttttctttcttcattcatctgataatggacacttagactgatttcttagctattatgaatagtgcttcaataaacataggagtgtagatctctctttg

SEQ ID NO: 35216 - DNA, 2037 bp, Homo sapiens
atccttttcttctatgaaaagatccagaaaagaggcaaagcaagcgagaagtcgcgggcccagcccacagcagggagtctgtgaccttcgaggatgtggctgtgacatttacccaggaggagtgggggcagttggacgtgacccagagggccttgtacgtggaggtgatgctggagacctgtgggcttctggtcgcactgggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtgggaaagacttcaaccgcaggtcacacctcacacggcaccagcggactcacaatggagataagccctttgtgtgcagtgaatgtggaaggaccttcaatcgcgggtcgcaccttacacggcaccagcgggttcacagtggagagaagccttttgtgtgcaatgaatgtggaaaggcctttacctaccgctccaattttgtcttgcataacaagagccacaatgagaagaaacccttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcag

SEQ ID NO: 35217 - DNA, 2361 bp, Homo sapiens
agctacttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaag

SEQ ID NO: 35218 - DNA, 1161 bp, Homo sapiens
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaatgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggttt

SEQ ID NO: 35219 - DNA, 3192 bp, Homo sapiens
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggcgtatatattttgacattacatttattttttaaaatcttctaaattttttgtttaataaaagcacacattataaaaattcaaaaattaccaaaaatgtgaaaattaattctcccctaacatccagttctgtagccactcactttccacagatgcaacaactgctatcagtttccttttattctaacgggaatatttcatgtaaatttcataaattctttggacaaaagtaggttattcataatatgtgatttattacacattctcattattagtccacatttggcctacttcattttttttttttttgagacacacccaggctggagtccagtggtgcaatcttggctcactgcaacctccgccacccaggttaaaaattctcctgcctcagcctcctgagtagctgggactacaggcatgcgcagccactatgcccggccaataagctatatttattcttatttgatgtggatgaaaattatcaaaattggccaggcttggtggctcatgcctgtaatcccagcactttgggaggccgaggcgggcggatcacgaggtcaggagatcgagaccatcctggctaacatggtgaaaccccgtctctacta

SEQ ID NO: 35220 - DNA, 774 bp, Homo sapiens
gaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctgatgcaacaactgctatcagt

SEQ ID NO: 35221 - DNA, 1742 bp, Homo sapiens
agaatctctcctgtccagtggtaagagaataagtaaaaaaggcaaatgtctcggaattagtatgaaaatagctttgaccttatagacttcctgatagggtctcaggtaccctctgtggtccttggaccacccattgagtactgctgctatatagtaatgaaaattaagaaactactactatttgtaatattacaaatgaacctcacatgtggtactggacagaagatgctggagaaaaaagtacctcctatatcattccatttattggaaattcagaaatagacaaaaaccactgcatagtgtaagaaggcaggatatcgcctacctttggtggacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaat

SEQ ID NO: 35222 - DNA, 2584 bp, Homo sapiens
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcagagatgtggctatagatgtctctcaggaggaatgggaatgcctgaacccagcgcagaggaatttgtacaaggaggtgatgttggagaattatagcaacttggtgtcacttggactttctgtttctaagccagccgtaatctcctcattggagcaagggaaggagccctggatggttgtgagggaagagacaggaagatggtgcccaggtacatggaaaacttggggatttcacaataatttcttggacaataatgaggctacagacataaatgcagacttggcatccagagatgagccccagaagttatctccaaaaagggatatttatgaaacagaattatcccagtgggttaacatggaagaatttaaaagccatagtcctgagagatcaattttcagcgctatctgggaaggcaactgtcattttgagcaacatcagggacaagaggagggttattttagacaacttatgattaaccatgaaaacatgcccatttttagccaacatactttactcactcaagaattttatgatagagagaaaatctctgaatgtaaaaagtgtagaaaaatcttcagttaccatttattttttagtcaccacaaaagaactcattctaaagaactttctgaatgtaaagaatgcacagaaattgttaatacaccatgcctttttaaacaacagacaattcaaaatggtgacaaatgcaatgagtgtaaagaatgttggaaggcctttgttcattgctcacaacttaaacatctaagaattcataatggtgaaaaacgctatgaatgtaacgaatgtgggaaggcctttaattatggctcagaacttactctacatcaaagaattcacactggtgagaaaccttatgaatgtaaagaatgtgggaaggcctttagacagcgatcacagcttactcaacatcagagacttcatactggtgaaaaaccctatgaatgtaagcaatgtgggaaggcttttattcgtggctttcaacttactgaacacctgcgactccatactggagagaaaccttatgaatgtaaagaatgtggaaagacttttaggcatcgctcacatcttactatacatcagagaattcatactggtgagaaaccctatgaatgtcgggaatgtgggaaggcctttagctatcactcaagcttctcacaccatcagaaaattcattctggcaagaaaccttatgaatgtcatgaatgtgggaaggctttttgtgatggcttacaactaaccctacatcagaggattcatactggtgagaaaccctatgagtgtaaggaatgtgggaagacttttagacagtgttcacacctcaaaagacatcagagaattcatactggtgagaaacctcatgaatgcatgatatgtggtaaggcctttagacttcattcacaccttattcaacatcaaagaattcatactggtgagaaaccctatgaatgtaaggaatgtgggaaggcctttagctatcattcaagcttctcacaccatcagagaattcattctggaaagaaaccttatcaatgcgggaaggcgtttaatcatagattacaacttaacttacatcagactcttcatactggcgagaagccagtcaggtttcctctcctccctccccatcctagtctagcatcatgaaatttgttgatggaaatatacattgtctttgttttatttaaggaaaaagttggtaagccaccagtttcattagtatttatttatttaaataatccttgaaaatcaaatgtttttaagtgagaaagtggataactaaagtgtaaattttggtctcattttaatgctgtttctgagttattgtattaaccattattgagaataaatttttttattgagaataaattttctaaaattacatgtttcactgaaaccagtgaaatatttcactgaaacagtgaaataaaatgaaaacaatttcctcccttccctcaaatctctgagataaccagtatgtgtatttcttcttcctttatgctcaaacaacctgtacacagaaagcattttttgcatgtgtttggaggagcttttacccccatacagacatttgacagcgtcttgtccttttcataataatcatgaatacttttccaggtcagtacgtaaagatgtaacccattctttgtaaggttcagaatatttctagaatggaatgtatgtccgtattttgggccattacctactacagacattgaagttgtttctaatgttcacctagaactctaattttaccttcttttgtttctattgtgcagattcccaacagtgggattaaagagtatctggc

SEQ ID NO: 35223 - DNA, 2553 bp, Homo sapiens
gagctcccacttccacacctactccaggctcggagccttaggaccatcacctgcccacctaagcccacggtgctccctcctgggaccccactcctgaaaccccctgcccctgcctcccccagcccggtgcgccggggctctccgcccgctccctcggtccctcctcccttgcaggcgccgtttcccggcttcgactccccgcgcgtctatccctctcctccccgcgaagtttcggggctgtcagtctgtcagtctttcaggccgtcagcacccgagctgcaggcggcgagcgccattgtgagcagagccggcggggcaggaggcccgggcgcctgggtccccgcggcgcgggcggagcggccggccagccaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccgcagcttcacgcagcgcgcccacatgctactgcatcagcgcagccaccgcggcgagcggcctttcccgtgctccgagtgcgacaagcgcttcagcaagaaggcccatctgacccgccacctgcgcacgcacacgggcgagcggccctacccgtgcgcggagtgcggcaagcgcttcagccagaagatccacctgggctcgcaccaaaagacccacaccggcgagcggcccttcccctgcacggaatgcgagaagcgctttcgcaagaagacgcacttgattcggcaccagcgcatccatacgggcgagaggccctaccagtgcgcacagtgcgcacgcagcttcacgcacaagcagcacttggtgcggcaccaaagggtgcaccagacggccggcccggccaggccctctcccgactcgtccgcttctcctcattccactgccccgtccccgaccccatcctttcccgggccaaagcctttcgcgtgctccgactgcggcttgagcttcggctggaaaaagaacctcgccacgcaccagtgtctgcaccgcagcgagggtcgcccctttgggtgcgatgagtgcgcactgggcgccaccgtggatgcccccgccgccaagcccctggccagcgcgcctggcggaccgggctgcggcccaggatccgatcccgtggtgccccagcgcgccccctcgggcgagcggtccttcttctgcccggactgcgggcgcggcttctcccatgggcagcacctggcgcggcacccgcgcgtgcacacgggcgaacggcccttcgcctgcacgcagtgtgaccgccgcttcggctcgcggcctaatctggtcgcccactccagggcccacagcggcgccaggcctttcgcctgcgctcagtgcggccgccgcttcagccgcaagtcgcacctgggccgccaccaggcggtgcacactggcagccgcccccacgcctgcgccgtctgcgcccgcagcttcagctccaaaaccaacctagtccgccaccaggcgatccacacaggctcccgccccttctcctgcccgcagtgcggaaagagcttcagccgcaagacccacctggtgcggcaccagctcattcacggcgaagccgcccacgcggccccggacgccgcccttgcggccccagcctggtccgctccccccgaggtggcgccgcccccgctcttcttctgagcctagttctcacgaggaccctttcttgcccacagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaa

SEQ ID NO: 35224 - DNA, 13203 bp, Homo sapiens
atgcctggggagcgcccccgaggagcgccgccccccaccatgactggagacctgcagccccgccaagttgccagcagcccggggcacccctcccagccgccactggaggacaacaccccagctaccaggaccaccaagggtgccagggaggctggcggccaggcccaggccatggagctccccgaggcccagccaaggcaggccagggacggggagctcaagcccccatccctgagaggccaggccccgagcagcacccctgggaagaggggcagcccccagaccccaccggggagaagccccttgcaggctccctcaaggctggcgggcagggcagagggcagccccccacagcgctacattctgggcatcgccagctcgaggaccaagcccaccctggacgagacaccagagaacccacagctggaggctgcccagctccctgaggtggacaccccccagggccctgggactggagctccactcaggccgggcctcccaaggactgaggcccaacccgccgccgaagagcttggcttccacaggtgcttccaggagccaccctccagctttacctccaccaactatacctcaccaagcgccacccccaggcccccagccccggggcccccccagagcaggggcaccagccccctccagcccggttcctatcccgaataccaggccagtggggccgactcctggcctcccgctgctgagaatagcttcccaggtgctaatttcggggttccccccgccgagccggaacctattcccaaaggcagcaggcccggcggcagccccaggggagtttccttccagttccccttcccggcactgcatggggccagcacaaaacccttccctgcggatgtggctgggcacgcattcaccaatgggccactggtgtttgccttccatcagccccagggagcgtggccggaggaggccgtgggcacgggccctgcctacccgctgcccacccagcctgcgccctcacccctgccctgctaccagggccagccaggtggcctgaaccgccacagcgacctcagtggtgccctctcttcccctggagctgctcactcggccccgagacccttctctgacagtttacacaagagcctgaccaaaatccttcccgaaagaccaccttcagcccaggatgggctggggagcacgagagggccccctagctccctaccccagaggcactttccagggcaggcgtacagagccagtggggtggacaccagcccggggcctccggacaccgagctggccgccccagggcccccacccgccaggctgccccagctgtgggaccccacagcagccccttaccccacacctcctgggggccccctggctgccaccaggagtatgttctttaacggccagcccagcccaggccagcggctctgcctcccccagagtgcccccctgccttggccccaagtgctcccgaccgcccggccaagtccccacggaatggagatgctgagccggctgcctttccccgcggggggccccgagtggcaggggggcagccaaggagccctgggcactgctggcaagacaccgggacccagagagaagctgccagccgtgagaagcagccagggcggctccccagcactgttcacctacaacggaatgacagaccctggggctcagcccctgttcttcggggtggcccagccccaggtttcaccccacgggacacccagcctgcccccaccgagggtagtgggagcctcccccagcgagtccccactgccgtcaccggccaccaacacggccggcagcacctgctcttccctgtcgccgatgtccagcagcccagccaaccccagctcagaggaaagccagctccccggccccctcgggccctcggccttcttccacccacccactcacccccaggagacgggcagccccttcccgtccccggagcccccccactccctccccacccactaccagccagagccagccaaggccttcccttttcccgcagatgggctgggagccgagggtgccttccagtgcctggaggagaccccattcccccacgagggccccgaggtgggtcggggagggctgcagggcttcccccgtgcgccgcctccgtaccccacacaccacttctccctcagcagcgccagcctggaccagctggacgtgctgctgacctgcaggcagtgtgaccgcaactacagcagcctggcggccttcctggcccaccggcagttctgtggcctgctcctggccagggccaaggatggccaccagcggtctccaggcccccctgggctcccctcgccccccgctgcccccagagtccctgccgacgcacacgcgggcttgctcagccacgcgaagaccttcctgttagctggggacgcccaggccgagggcaaagacgaccccctgaggacaggcttcctgcccagcctggccgccacccccttcccgctccctgcctcggacctggacatggaggatgacgccaagctggacagcctcatcacagaggcgctcaacggcatggagtaccagtcggacaacccggagatcgacagcagcttcatcgacgtcttcgcggacgaggagccttccggccccagaggtcccagctccggacacccccttaagagcaaggcgggggtgactccagagagcaaagctccgcccccgctcccagcagccacgccggacccccaaaccccccgccctggggacaggggctgcccagcccgaggcaggcccaaaacgcgttccctgggtctggcccccaccgaggcggatgcgcccagccagggcaggcagcagaggagggggaagcagttgaagctgttccggaaggatctggactcgggcggcgcagcagaggggtcggggtcgggcggcggcggcagagcctccggcctgaggccccggaggaacgacggtctcggggagcggcccccaccccgtccccggcgccctagaacgcaggcccccgggagccgcgcagaccccgcgccccgggtcccgagagccgccgccctccccgaggagacccgcagctcccggcgccgccggctgccccccaggaaggaccccaggaagaggaaggctcggggcggcgcctggggcaaggagctcattctgaagatcgtgcagcagaagaacaggctccgcgagtacgacttcgcctcggagtccgaggaggacgagcagcctccgccgcggggccccggcttcagaggccggcggggccgaggcgagaagaggaaggaagtggagctgacccagggtcccagagaggatgagccacagaaaccccggaaggcggcgaggcaggaagccggcggggacggagcccccgcgaaccccgaggagccgggcgggtctcgcccgggccccggcaggagccctcaggcccgtggcccgtctcgaagcctggagacgggagcggccgccagggagggaggccccaagtgtgctgatcgcccctcagtggcccccaaggatcccctgcaggtccccaccaacaccgagacctcagaggaaacccgcccgtcgctggactttccccaggaggccaaggagcctgaaactgccgaagagtcagccccggacagcacagaattcacagaggctttgcgttctcctccagccgcctgtgcgggagaaatgggagcaagccccggtctcctgataccagagcagccgccgcccagcagacatgacaccggcacccccaagccgtcgggaagcctcgccaacacggcgccccacggaagctcgccaacgccaggtgtgggcagcctgctgggtggtcctgggggcacacaggccccagtctcccacaacagcaaggacccccctgcccgccagcctggagaatttctggcacccgtggctaacccctcaagtaccgcctgccccaaacccagtgttctgtcttcaaagatctccagttttggctgtgaccctgctggttttaacagagaccccttgggggttccagttgccaaaaaggggcctcagccctacagcagcccccacagtgagttgttcctcggacccaaagacctggctggctgtttcctggaagaactgcaccccaagccctcagccagggatgccccgccggccagcagctcctgcctttgccaggacggcgaggatgccggttccctcgagccacagctgccaaggagcccacctggcaccgctgagacggagccaggcagggctgcatcgccaccgaccttggagtcctcatccctcttcccagacctgccggtggacagattcgacccacccctctatggcagcctgtctgcgaacagggactccggtctgccgttcgcatgtgccgaccctccccagaagacggtgccgtcagatccaccgtacccctcttttttgctgcttgaggaagtatccccgatgctgcctagccattttcctgatctctcggggggaaaggtgctcagtaagacgtgtccccctgaacggacagtggttcccggcgccgccccatctttgcctgggaaggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccgtggaagcggttcaggggaggcctggggggacgtggccctgcccagcctccttccatccgggacatgcagcccttctcccctgtgcccaggaagacctggtttctggggctcctttcagccccaggggagccaacttccattttcagccagtgcagaaagccggagcctccaagactggactttgccaggcagaaggagacagcaggcccccccaagatgtctgcctgcctgagcccagcaagcagcctggcccacagctggatgccgggagtttagcaaagtgcagccccgaccaggaactttcatttcctaagaataaggaggccgccagctcacaagaaagtgaagactccctgcggctgcttccctgtgaacagagaggagggttcctcccagagcccggcacagcagaccagccccaccgaggggcccctgctccagaagcttttggcagccctgctgtccatctggcccctgacttggcatttcagggtgacggggctccacctctggatgccacctggccttttggtgccagtcccagccatgctgcccagggacattctgcaggcagagcaggtgggcacctccaccccacggcagggaggcctggctttgagggtaatgagtttgcaccggcgggggcctcctcactgactgccccccggggcagggaggcttggttggtccctgtgccaagtcccgcctgtgtatccaacacccaccctagcaggaggtcccaggacccagctttgagcccccccatacgtcagctccagctcccagggcctggagtggctaagagtaaagatggcatcctgggcttgcaggagctgacacctgctgcccagagccctccacgagtgaacccctcaggtctggaagggggcactgtggaaggagggaaggtggcctgtggccccgcccagggctccccagggggtgtgcaggtgacaactctccctgcagtggccggacatcagctggggctggaggcagatggacattggggcttgcttggccaagccgagaaaacccagggccaaggcacagccaaccagcttcagccagagaacggggtgagcccagggggcacggacaaccacgcctcagtcaatgccagtcccaaaacagcgctgaccggccccaccgagggtgcagtcctgctagagaaatgcaagggaagcagggcagccatgagccttcaggaggaggccgagcccaccccaagccccccgtcccctaatagggagtccctggcgctggccttgacagcagcccacagccgaagtggatctgagggccggactccagagagggcgtccagccccggcctgaacaagccactgctggccacaggggatagcccagcaccctctgtcggggacctggccgcctgcgccccctcacccacttcagccgcccacatgccctgcagccttgggcccctgccccgtgaagacccacttacctcgccttccagggcccaaggtgggctgggggggcagctgccagcatctccgtcctgcagggaccctcccggcccccagcagctgctggcctgttctcctgcctgggcacctctggaagaggcagatggcgtccaagccacgacagatactggggctgaggattccccggtggctcccccgtctttgacaacaagcccctgcgatcccaaggaagccctggctggttgccttctccagggggagggcagccccctggaagacccttcctcctggcctcctggctccgtcagtgctgtaacctgcactcacagtggggacacccccaaagacagcactttaagaattccagaggattccagaaaagagaagctgtgggagtctcctggccgagccacctctcctcctctggcaggggccgtctcccccagcgtggccgtcagggctactggcctgtccagcactcccaccggagatgaggcacaggcaggcaggggactcccagggccagacccccagagcaggggagccccgccccacaccaaccctgacaggatgcccaggggccactcctcgtattctccaagcaatactgcccgcctcggccacagggagggccaggctgtcacagctgtgcccactgagcctcccacgctacagggtgcagggccggactcccccgcctgcctggaaggtgagatggggaccagcagcaaggagccggaggacccagggacccctgagaccgggcgctctggtgctaccaagatgcccagggtcacctgcccttccacaggactgggcttgggaagaaccacagccccaagcagcacagccagtgacttccagtctgactccccccaaagccacagaaatgcctcccaccagactccccagggggaccccctcggcccccaagacctcaaacagaggtcccgtggctataaaaagaagcctgcatctacagagaacggccagtggaagggccaagctccacatgggcctgtgacctgtgaggtctgcgcagcctccttccgctccgggccgggcctgagccggcacaaggccaggaagcaccggccacacccgggagcccccgcggagccgagcccagcggccttgcctgctcagcagcctctagagcccctagcccaaaagtgccagccgcccaggaagaaaagccacagggtgtctgggaaggagagaccaaatcactcacggggagaccccagccacgtcacccagccaccgcctgcccagggctcaaaggaggttctcagagcaccggggtccccacacagccagcagctgcaccctccaagccctactgagcatgaggtagatgtgaagactccggcctccaagcccagaccagaccaggccagggaagatgagctgcatcccaaacaggcagaaaaaagagaaggccggaggtggcgccgagagcccaccgtggactctcctagccactcagaggggaagtcaaataagaaaaggggaaagctgagagggagaaggctccgggaggagagcattcttccagtctctgctgatgtgatttcagatgggcgcggctccagaccatcccctgcaatggccagttacgcagcctctccgagccactgcctctctgtggaaggagggcctgaggctgacggggagcagccgcctcgcttggccactctgggacctggggtgatggagggtgcagcggagactgaccaggaggctctgtgtgcaggggagactggggcccagaagccacctggagatcggatgctgtgtccagggaggatggatggtgcagctctgggggaacagccaactgggcagaagggagcctcggcaagggggttctggggaccaagagagaccaaggcgttgggtgtgtgcaaagagtctgggagcgagcctgcggaggacagcagcagggcccacagccgatcagaggaaggtgtctgggaggagaacacgccccccttgggccccctgggttttcccgagacttccagctctccggcggacagcaccaccagcagctgcctccagggcctcccggacaacccagacacccagggtggagtccaggggcctgaaggccccactcctgatgcctctggctccagtgccaaggatcctccaagcttgtttgatgatgaggtctctttctcccagctcttccctccaggcggtcgcttgactagaaagaggaacccgcatgtctacgggaagcgctgtgagaagccggtgctcccgctgccaacccagcccagctttgaggagggcggtgaccccacgctgggcccagcccgcctgcccacggacctcagcgactccagctccctctgcctctgccatgaggacccgtgggaggacgaggatcccgcaggtctgcccgagtccttcctcctggatgggttcctcaatagcagggtgcctggcattgacccctgggcccccggcctcagcctgtgggccctggagcccagcagggaagctggtgcagagaagctgccctcccactgccccgaggacgatcggccggaggccattcctgagctgcacatggtcccagcggcttggcgaggcctggagatgccggcccctgccgatgactcctcctcttctctcggagatgtgagccccgagccccccagcctggagagagaacgctgtgacggtgggcttcccgggaacacccacctgctgccgctccgtgccacggactttgaggtgctcagcaccaagtttgagatgcaagacctgtgctttctgggaccctttgaagaccccgtgggtctccccggccccagcttcttagacttcgagggcacggcgagctcacaggggccacagagccgaaggacagaggaggctgcaggggcagggagggcccaaggcagaggccggccggccaagggcaggcgggcctcctacaagtgcaaagtgtgcttccagcgcttccgcagcctgggcgagctggacctgcacaagctggcccacacgcccgcgccgccgcccacctgctacatgtgcgtggagcgcaggtttggctcgcgggagctgctgcgggggcacctgcaggagaggcacgcgcagagcaaggccgggccctgggcgtgcggcatgtgcctgaaggaggtggccgacgtctggatgtacaacgagcacctgcgtgagcacgcggtccgcttcgcccgcagggggcaggcgcggaggtccttgggggacctgcccggaggcctggagggcagcagcgctgtcgcccaccttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagcaacccagacggggccgcgaccccagacagcgcctctgccaccgccctggctgacgccggcagcccgggcccccccaggacgacccccagcccgtcccccgacccctgggccggcggggagcccctcctgcaagccaccccggtgcacgaggcctgcaaggacccctcccgcgactgccaccactgcgggaagcgcttccccaagcccttcaagctgcagcgccacctggcggtgcacagcccgcagcgcgtctacctgtgcccccggtgcccccgggtctaccccgagcacggggagctgctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcctccccggggaagcagccccatcctgagtgagggctctctcccggccctgctccacctgtgttcggaggtggctcccagcaccaccaagggatggcccgagaccctagagaggcctgtagaccccgtgacccacccgatcagaggttgtgagctgccatccaaccaccaggagtgtcccccgccgtctctgtctcccttcccagctgccttggctgatggcagaggagactgcgcgctggacggagccctggagaggccagagaacgaggcttccccaggcagccccgggcctcttctccagcaagctctccctctgggggcatctctgccgcggccgggagccagaggccaagatgcggagggaaagagggctcctctcgtgttctcagggaaacgcagggccccgggtgcccgtggcaggtgtgcccctgaccatttccaggaagaccacctacttcagaaagagaaggaggtgtcctcaagccacatggtgtctgagggggggccccgaggcaccttccacaagggcagcgccaccaagcctgcgggctgccagagctcatcaaaggacaggtcggcagcatccacccccagcaaagcactcaagttcccagtgcacccaaggaaggcggtggggagcctggcacccggggagctggcccgtggcacagagaatgggatgaagcccgccacccccaaagccaaacccggccccagctcccagggcagtggaagccctcgccccggcaccaagacaggaggtggcagccagccccagccagccagcgggcagctccagagcgagacagccaccaccccagccaagcccagcttccccagccggagccctgcaccagagaggctccccgctcgagcccaagccaagagctgcaccaaggggccaagggaagctggtgagcaggggccccacgggagcctaggtcccaaggagaagggagagagcagtacgaagaggaaaaagggccaggtcccagggccagccaggagtgaaagtgtggggagcttcgggagagccccctcagcccctgacaagcccccccggacccctcggaagcaggcaactcccagccgcgtgctcccgaccaagcccaagcccaacagccagaacaaacccaggccgccaccatcagagcagcggaaggcagagccgggccacacacagaggaaggacagactgggcaaggccttcccccaggggagacccctgctcaggccccccaagaggggcacagctgtccacggtgctgaacctgccgagccacacacccaccggacggccgaggcccagagtgacctcctcagccagctcttcgggcagagactaactggcttcaaaatccctttaaagaaagatgcttccgagtaatttctaggagcaagagcctgggaccggagctgggcgttcctgtctcggcctgcctccttggccagctccggctccctgagatggtccactctgtggccacttgacttcttgtgcaactgctcaggccttgatgtcagagctgaggtggtgatgctttgaacagggcccaggtgggcagcattccctttcttgctggaaggctgggggtgaaagacggggccactgcagcccttttgagaccacacagctgttttcttggtaccaagtacttgaagagacagcagcccatcccctcagcccacacccctgcgccctgtgggcaccgacaccacagaagccaatgtttggagatttgcacaacctcccgttcccccacatggagaagggaagtaagttgaggcagccgtgggatggtggtaggttccctcttagtcttgctgctgttgctggaattccaaagtgaccttagaaaccacgtgggggaaggcagtgctcactacttagaagggttgcttctgagccgcctggtcccccaagagcacaacaggcctcctccctctgaccacagggtcatgcctcctccctctgaccacagggtcatgccagcctccatttgctctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatgttactctgaagtttctggtgctatttttgtgttgtaatgtgaatacaggcttccttgatttttttttttaatgggggtattgggtgggacagacggggtcagggaggccccaccatggcttgtcgagggcacgggcacctgcatggcggcgctctccctgcctcccctgccgggctgcaagcctgaggtctgtgctgccagacggggatgctcagggctggggctgcagagccgctgccctggccagggcaccctcatgcaccgacccaacccaggcctgggacgcacgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaacctc

SEQ ID NO: 35225 - DNA, 1833 bp, Homo sapiens
aaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctggggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacg

SEQ ID NO: 35226 - DNA, 2722 bp, Homo sapiens
gattgacttctaaagagtcatgctgtgtgatgaaaaagcccagaagagaaggaagaggaaagcaaaggagtcagggatggctcttcctcaggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatacacagaactaaaaacaaaaaccacatgaccatgatcatctctttagatgcagaaaggtttttaataaaattcaacatcccttcattttaaaaaccctcaacaaattacacattgagggaacatacttcaataagaaccatctatgctggactcacagccaaattaatactgaacaagcaaaagctggaagcattccccttgagaactggaaaatgacagggatgaccactctcaccactccgattcaacatagtactggaagtcctaagcttagtgatcaggcaagataaagatatgaaaggcatatataaataggaagaggggaagtcagtttctcttgcagaagatataattctgtatttagaaaacctgttgtctctgcccaaaggctcctagatctgat

SEQ ID NO: 35227 - DNA, 535 bp, Homo sapiens
ttcccacaaacccggaagcggatcgcgtggagtgaaggtcacgccgcggcgcgattgacttctaaagagtcatgctgtgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaact

SEQ ID NO: 35228 - DNA, 2512 bp, Homo sapiens
acaaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatacacagaactaaaaacaaaa

SEQ ID NO: 35229 - DNA, 4738 bp, Homo sapiens
acaaacccggaagcggatcgcgtggagtgaaggtcacgccgcggcgcgattgacttctaaagagtcatgctgtgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcacaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttggttcagtatacacaaatcaataaatgtgatttatcacatacacagaactaaaaacaaaaaccacatgaccatgatcatctctttagatgcagaaaggtttttaataaaattcaacatcccttcattttaaaaaccctcaacaaattacacattgagggaacatacttcaataagaaccatctatgctggactcacagccaaattaatactgaacaagcaaaagctggaagcattccccttgagaactggaaaatgacagggatgaccactctcaccactccgattcaacatagtactggaagtcctaagcttagtgatcaggcaagataaagatatgaaaggcatatataaataggaagaggggaagtcagtttctcttgcagaagatataattctgtatttagaaaacctgttgtctctgcccaaaggctcctagatctgataaacaacttcaaaaaagtttcaggatacaaaatctgtgtacaaaaattagttgcatttctatacaccagtaatgtccaagctatgaaccaaatcaagaatggaatcccattcacagtagccacaaaaagtataaaatacctaggaatacagccaaccaggtaagtgaaagatttctacaatgagaattacaaagcagtgcacaaagaaatcagaaacaataaaaattgaaaaatatctcatgctcatggataggaagaatcagtattgttaaaatactgcccaaagcaatttacagagccaatgctatttctatcaaactaccaatggcatttttcacagaatcagaagaaaacattctgaaatttatttggaaccagaaaagcccaacctaaatagcaaaagcaatcctaagcaaaaagagcaatgtttgaggtatcacactacccaactttaaaccatactacaaggctacagcaactaaaacagcatggtactggtataaaaaaagacacatagatcaatggaataggtaagagaacccagaaataaaggcatatacctacaaccatgtgatcctcaacaaaactgacaagcaatgaagtaagaacttcattcaataagtggtgctggcataactggctagccatatgcaggatattgaaactggacccctatccttcacgatatacaaaaatcaactcaagatggattaaagacttaaatataaaacctaaaagtattaaattcctagaagaaaacccaggaaatgccattctggacataagtgctggaaaagacttaatgatgaacaccccaaagcaattgcaacaaaaacaaaaattgacaagtgggacctaattaaactaaataacttctgcacagcaaaagaagctatttgcagactacagaatgggagaaaatgtttacaaactgcatctgacaaagatctaatccagaatctataaagaactcaaacaaatcaacaatgagaaaaacaaccccattaaaaactgggcaaaggccatgaatagacctttctcaaaagaatacatacatgtggcaataagcatatgaaaaaaatggttaatatcgctaatcattaaggaaatgcaatcaaagccacaatgagataccatctcagacctgtctgaatgggtattatcagaatgggtattattaaaaaatcaaaacatagatgctagtgaggctgcagagaaaagcaaatacttatacactgctggtgggaatgtaaattaattcagccattgtggaaagcactgcagcgatttctcaaagacataaaagaacatagcattcaacccagcatcccattactgggtgtatacctaaaggaatataatcattccaccataaagacaaacacttgtatgttcattgcagcactattctcaatagcaaagatgtggaatcaacgtaaatgcccatcagcagtagaccagataaagaaaatttggtacatatacaccatggaatactatgcagccataaaaaagaacaagactgtgtcctttacagcaacatagatggagctgaggctcttatcctaagtgaattaatgcaggaacagaaaatgaaatatcccatgttctcacttataagtgggagctaaacattgattacacatggactcaaagaagggaacagtagacacgggcttatgggtggaggttgggaagaggatgaagattgaataactgcctgttgggtactatgctgattacctggggacaaaattaactgtacaccaaactcctgcaacatgcagttgacccatgtacacatactccttgaacctaaaataaaacatgaaaaaaagcaaa

SEQ ID NO: 35230 - DNA, 5336 bp, Homo sapiens
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaatat

SEQ ID NO: 35231 - DNA, 2535 bp, Homo sapiens
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagaatttttcaatttaataatcatcgcagcaatggttatattttagaaatgttaggaagtggagggaagaaagcacagataatttcagtcctgtcacagatctacgtgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtg

SEQ ID NO: 35232 - DNA, 2166 bp, Homo sapiens
gctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtga

SEQ ID NO: 35233 - DNA, 3347 bp, Homo sapiens
ctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtattaaagggttttacttctt

SEQ ID NO: 35234 - DNA, 2362 bp, Homo sapiens
gattggaaggcggcaaaggctttaatctcccccttggtgcagctgcttttgaagtgagtttcctcgccagagccccggctggacacgcagcggctcgcatcgcagagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatag

SEQ ID NO: 35235 - DNA, 2139 bp, Homo sapiens
catgaatggaagcggcggcggcggcgggagcggcctgagctgggcgccggggccagggccgggggctgcccagggcccgcgccgctgcatgggggcggcccgcgggccctgagaggaagggcagacaggcgggccgagataggaggggcggggtcgggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagcca

SEQ ID NO: 35236 - DNA, 2077 bp, Homo sapiens
aggagcgggggtggggtcagtggagtgggctcaggtcagggtggagggggactcctgagggatgaagtgggcgatccagactcctagcttcccaccgaggcactaagggaatcagagtgggtcagcgagtacgggaagtgtggtccacgagggctggttcctgagggagaatccacaagccccctcccctcttcagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaa

SEQ ID NO: 35237 - DNA, 4971 bp, Homo sapiens
agtccgggtcttggcgggccccctcctccctcccgctccccgcgctctcgccttttaatcatgcccctctgtctgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccattagg

SEQ ID NO: 35238 - DNA, 3933 bp, Homo sapiens
atatctagagcccagaaagcacaaacaagaagattaaatgaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcaggttcacactgccacacccaggcaatcc

SEQ ID NO: 35239 - DNA, 4139 bp, Homo sapiens
agtccgggtcttggcgggccccctcctccctcccgctccccgcgctctcgccttttaatcatgcccctctgtctgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcaggttcacactgccacacccaggcaatcc

SEQ ID NO: 35240 - DNA, 3954 bp, Homo sapiens
agggtctgtgtcaagagcggcaggggctgcaggagataagagaaacgggctgccgtggggtgtgtgtaggcttcagagacatgggatcacggaagactgaagcagaaacagtggattaagacttcctgagcgatagctggcactgccttccccacaatggcagaggtggtggctgaggtggccgagatgccaacacagatgtcaccaggggcagtggagatgtcaacacctatgtcggcagagatgatggagatgtcaacagaagtgactgagatgacacctggggaggcccttgcctcatccctcttcttccagcatcaccagttcatgtgctctgagtgtggcagcctctataacacactggaggaagtcctctcacaccaggagcagcacatgcttgctgtctcagaggaggaggcactgaccacacagaatgttggcctggagccggagctggtgccgggtgctgaggggcccttccagtgtggtgaatgcagccagctcatcctctcccctggggagctcctggcccaccaggatgcccacctccgagagtctgcaaaccagatccaataccagtgctgggactgccaggagctgttcccctcgcccgagctgtgggtggctcatcgaaaggcccagcacctttctgctacggtagctgagccaccagtgccacctcctttgcctcccccaacaccactgcctccaccttctcccccatccgaagtcaagatggagccctatgagtgtcctgagtgctctaccctctgcgccacccctgaggagttcttggagcatcagggcacccactttgactccctagagaaagaggagcgcaatgggttggaggaggaggaagaggacgatgaggaggatgaagaagatgatgaagagatggaggatgaggaggccatggcagaggtcggtgatgatgctgtgggaggtgacgagtccacagctggctgggctcagggctgcggggactgtccccagcaccagccctcagcaggggctcgccggcaacaccggcggacggctcacagcccggcatctgccacccaccccttccactgcagccagtgtcagcgcagtttcagctccgccaaccggctgcaggctcatgggcgggcccatgttggtggcacacatgagtgtacaacctgctccaaggtcttcaagaaagcagcatcgcttgagcagcacttgcggctgcatcgcggggaagcccgctacctctgtgtagactgtggccgcggctttggcacagaactcacgttggtggctcaccggcgggcccacactgccaacccattgcatcgctgtcgttgcggcaagacgttcagcaacatgaccaagttcctctaccaccggcgcactcacgccggcaaaagcggggcacctcccacaggagcaacagctcccccagctccagcggagcccacccctccaccaccaccccctgccccacctgcccagctgccctgcccacagtgctccaagtcctttgcctcagcttcccggctgtcccggcaccggcgtgcagtacacgggccccctgaacggcgtcaccgctgtggggtttgtggcaagggcttcaagaagctgatccacgtgcgcaaccacctgcggacacacacgggtgagaggcccttccagtgccactcatgtggcaagacctttgcttctttggccaacctcagccgccaccagctgacccatacgggtgcacgtccctaccaatgcctggactgtggcaagcgcttcacacagagctccaacctgcagcagcaccggcggttgcacttgcggccagtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaagtgggttggccaaggccctttgcactgcatcaccctggtgcccagcaacatcaggtaaccttcactgagcaccaagcttatgccaggtctgtgctggccactctcatatacctcttcagatcctctgcttgtacccccagcccttgccttccctggattttgggcacccaggactttgctctgcctggtggagggtacttgatttctctgggcttccttcatctcaattctgacagtgtggaaggaaatctgtaggtacccaggtcctcagctccagactgggtgatgctggagacccaggagcaagtcagcacaggctctgcccacaggaggcatgcacaatctggtaggagaaacgcacaagtacagatagcttgctctctgagtgtgtctcattgattcattcagcctgtgtgtcctaaagcctcccttctcccatactgggtgatgctgggggcagagatgagtcaggcctaaggcttctctgggctgtgatggggatgtgcagggacagtgggatcccaggaaacagacctccatggtgggagatcaggagttaaggacttcctagagaaggtagtccctgaaggaaaagtaggaatctggcagtgaaagaggaaaagaacattccaggcagacagcactgcaagagggtgagctcttggtgtatttggagaccatccagttattcatctgactgcctacctgaggcaagcaccacacttaccactgtatgtgtactatgatcccaacaggcttgtgacatagatttcatattatccctgttgtatagatttttaaaactggtggctgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggagtggtggcgggcgcctgtggtggccagctactcaggaggctgaggcaggagaatggcgtgaacccgggaggcggagcttgcagtgagccgagatcgcgccactgcactccagcctgggcgacagagtgagactccctctcaaaagaaaataaaaataaaaataaactggccaggtgcggtggctcacgcttgcaatcccagtgctttgggagactgaggcaggaggatcacttaaggccaggagttcgagaccagcctgggcaacagcaagacctcatctctacaaaacttaaaagttagccaggcctggtggcacatgcctgtaatccgagtgctttgggaggctgaggcaggaggatcactcgagctcaagaattcaagacctgggcaagagagagagactttgtctctattaaaaataaaaatgattggccgagcatggtggtgcacaccagtattcccagctactctggaggctgaggcggaggcaggattgcttgatatgagggagattgaggctgcagtgagctgtgttcacaccactgcactccagtctgggcaacagtgcaagaccctgtcactt

SEQ ID NO: 35241 - DNA, 2417 bp, Homo sapiens
aatgggaggtgtggatagtgaggggtcccacacgcctggagccgagggtctgtgtcaagagcggcaggggctgcaggagataagagaaacgggctgccgtggggtgtgtgtaggcttcagagacatgggatcacggaagactgaagcagaaacagtggattaagacttcctgagcgatagctggcactgccttccccacaatggcagaggtggtggctgaggtggccgagatgccaacacagatgtcaccaggggcagtggagatgtcaacacctatgtcggcagagatgatggagatgtcaacagaagtgactgagatgacaccttctcccccatccgaagtcaagatggagccctatgagtgtcctgagtgctctaccctctgcgccacccctgaggagttcttggagcatcagggcacccactttgactccctagagaaagaggagcgcaatgggttggaggaggaggaagaggacgatgaggaggatgaagaagatgatgaagagatggaggatgaggaggccatggcagaggtcggtgatgatgctgtgggaggtgacgagtccacagctggctgggctcagggctgcggggactgtccccagcaccagccctcagcaggggctcgccggcaacaccggcggacggctcacagcccggcatctgccacccaccccttccactgcagccagtgtcagcgcagtttcagctccgccaaccggctgcaggctcatgggcgggcccatgttggtggcacacatgagtgtacaacctgctccaaggtcttcaagaaagcagcatcgcttgagcagcacttgcggctgcatcgcggggaagcccgctacctctgtgtagactgtggccgcggctttggcacagaactcacgttggtggctcaccggcgggcccacactgccaacccattgcatcgctgtcgttgcggcaagacgttcagcaacatgaccaagttcctctaccaccggcgcactcacgccggcaaaagcggggcacctcccacaggagcaacagctcccccagctccagcggagcccacccctccaccaccaccccctgccccacctgcccagctgccctgcccacagtgctccaagtcctttgcctcagcttcccggctgtcccggcaccggcgtgcagtacacgggccccctgaacggcgtcaccgctgtggggtttgtggcaagggcttcaagaagctgatccacgtgcgcaaccacctgcggacacacacgggtgagaggcccttccagtgccactcatgtggcaagacctttgcttctttggccaacctcagccgccaccagctgacccatacgggtgcacgtccctaccaatgcctggactgtggcaagcgcttcacacagagctccaacctgcagcagcaccggcggttgcacttgcggccagtcgcctttgcccgcgccccccgcctccccatcactggtctctacaacaagagtccctactactgcgggacttgtggccgctggttccgcgccatggcgggcttgcgactgcatcagcgggtccatgcccgagctcggactttgacgctacagcctcccagatcaccatctcctgccccacccccacctccagagcctcaacagactatcatgtgcacagagctgggggagaccatcgccatcattgagacatcccagccactggcgcttgaggacaccctgcagctgtgccaggctgcactgggggccagtgaagcaggcgggctcttgcagttggacacggccttcgtgtgacgcagctgaaaagcaacaacaaaagggtttggttgcaacagccagtgtgggtacctctggggagagaggacctcctctgacaaactggtctggtacccaccatgtgccaggatccaccctggcctctttttacccactgactccccagaacaacccttccaggcttctcttgtcatctttctctgcctgaggggaaactgaagctctgaaatgcgatgtgatctgtaccaggtcacccagctatgctgcaaagtgggttggccaaggccctttgcactgcatcaccctggtgcccagcaacatcaggtaaccttcactgagcaccaagcttatgccaggtctgtgctggccactctcatatacctcttcagatcctctgcttgtacccccagcccttgccttccctggattttgggcacccaggactttgctctgcctggtggagggtacttgatttctctgggcttccttcatctcaattctgacagtgtggaaggaaatctgtaggtacccaggtcctcagctccagactgggtgatgctggagacccaggagcaagtcagcacaggctctgcccacaggaggcatgcacaatctggtaggagaaacgcacaagtacagatagcttgctctctg

SEQ ID NO: 35242 - DNA, 3157 bp, Homo sapiens
agtctacaactggaaaccggccggatcgtgtctgcgcaggcccagcagctaagatcgggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataagcca

SEQ ID NO: 35243 - DNA, 3061 bp, Homo sapiens
agtctacaactggaaaccggccggatcgtgtctgcgcaggcccagcagctaagatcgggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataagcca

SEQ ID NO: 35244 - DNA, 2349 bp, Homo sapiens
agtctacaactggaaaccggccggatcgtgtctgcgcaggcccagcagctaagatcgggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaa

SEQ ID NO: 35245 - DNA, 3147 bp, Homo sapiens
ggccctagcggcttggcggagctggagccctccctggcagtgcgtcggcgctgggctatggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattgtaaagaatgtgggagtacttttaataatgtctatcagcttactctccatcagaaaattcatactggtgaaaaatcctgtaaatgtgagaaatgtgggaaagtttttagtcatagctatcaacttactctgcatcagagatttcatactggtgagaaaccctatgaatgtcaagaatgtgggaagacctttactctttacccacaacttaatcgacatcagaaaattcacactggtaaaaaaccctatatgtgtaagaaatgtgataagggtttttttagtagattagaacttactcaacataaaagaattcatactggtaagaaatcttatgaatgtaaagaatgtggaaaagtttttcaacttattttctactttaaagaacatgagagaattcatacaggtaagaaaccctatgaatgtaaggagtgtgggaaagcttttagtgtatgcggacaacttacccgtcatcagaaaattcatactggtgtaaaaccctacgaatgtaaggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtgaaaagccctataaatgtaaagaatgtggaaaggcctttattcgtagagggaatcttaaagaacatctgaaaattcattctggtttaaaaccctatgactgtaaagaatgtgggaagtcctttagtcggcgtgggcagttcactgaacatcagaaaattcatacgggtgtaaaaccatacaaatgtaaagaatgtgggaaggcctttagtcgtagtgtagaccttagaatacatcaaagaattcatactggtgagaaaccctatgagtgtaaacaatgtgggaaggcctttagacttaattcacaccttactgaacatcagagaattcacactggtgagaaaccctatgagtgtaaggtatgtagaaaggcctttagacaatattcacatctttatcaacatcagaaaactcataatgtaatttaatataagaaaaggtttccatgtcatgctctatttatagaatatcaaaatatttatggccagaagttctgtcaatgtgttgatgtttttttacacatattaacttaataaatgtatgagtcttaaatacctcttagttctcattaaatttaggaaaattcacactagaaaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtttccaacatgtataatacagcaacaactatctggcccaaactgctttggattaatattggatattactgtttttattatcatcaacattattattagtggatttcttaataggaagatgcaatggagatgacaaatttggaaaaaccactcatcacttacatttcatgaagtacttctttgataaaatctgttatgggctgaatgtttgtgttcccgtaacaattcctatgttgaaacacgaatcccaaggtgatggtatttgaaggtagggcctttaggaggaaattaggtcatgagggtggagccttcatgagtggaattactgcctttataagaagaagccaaagagccagctagctctttcaaccacatgaggttacagcaagaagtcagcagtctacagtgcaaaagagggccttcaccagaacccaagcatgctggcaccttgaccttggactttcagcctccaaaactgtgagaaataaacctcagttgtttataa

SEQ ID NO: 35246 - DNA, 1788 bp, Homo sapiens
gttagctccgcaaggacccggacgcgaccaggggaggcagaaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctttttgcctc

SEQ ID NO: 35247 - DNA, 2519 bp, Homo sapiens
acacacggagacgtgcgcgcacacccacttgtgcagagacacgcgcacgcagacacgtgcgcacagagacgcacacagacacacgtgtgcacacaggcaaacaggcacgcgcagagacgcacacagacacgcgtgtgcaccacaggcaaacagacacgtgcagagacgcacacacaggcacacgtgtgcacacacagagatgcaaacacagacacacgcgtgcacacactgacgcgcgcacagagagacacacgcgcgcacacacacgtctcccccgcgccagctccggctccagcagccttggggtccccgcccagacccgggctcctgactccctcaacgactgcatctcgcggggcgatcccggtcgggttccgcctgagccaaggccccgcacccaaaccgagacagcggatccagtagcccgaggcccgcagctgggcgaaggaaccgggactcaagagtagcctccggcaccgagccctccaagaaaagcagcccgggaccccgacaaccgtggacggagccagggtgggtcatagctcgaggcatcgtcaacggagggtccttaagagaccctgaacccattcacccgggcaccagagactctgccaaagcaccaattcgggcaggtggtagcctcgaagctgggaggctgcatctcaagcctcctcctagatccgcggtggaccctgggaaatgtagtccagagcaagccaccacctaaatgcgccgtggaccctgggaaaggtggtccctcgcaagtcaccgcctggacgcaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctt

SEQ ID NO: 35248 - DNA, 1942 bp, Homo sapiens
agaagtctccgcgacgcggcccgcctcggtcaccgcggccaggcccaggctggtactgaattaccttctattaccagcaacgtcgcttctcaggccttggactacatttcccttgaggctttactggtcgactctctgtctcctcccctccccccgcgaacttggccgcctccttctgtgacgatggagctcttgaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatctggctcagtactaggtaatttttaatgtagtgtaattaatgtcagaaaacacctgtcacttccatcatagaacatcagaaaactcacacccaaagaaaattaaataaatgtgggaattctttttgcctc

SEQ ID NO: 35249 - DNA, 4056 bp, Homo sapiens
gcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagctctacttctgcaggccccatcccttcccagaaagaagaggaaatgactgagtcccagggaacagtaacattcaaagatgtggctatcgacttcactcaggaggagtggaagagattggatcctgctcagagaaaactgtaccggaatgtgatgctagaaaactataacaacttaatcacagtaggctatccgttcaccaaacctgatgtgattttcaaattggagcaagaagaagaaccatgggtgatggaggaagaagtattaaggagacactggcaaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgttaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagcaaaattttaaaactatgatgaaagtagaatccgttactttagggtaacaagatttctttaaaaaacatgtaaacatggaatagtctgttgaattttggtgtattggcctcacaggcacccacaaatgtacacaaagagatatatatcactgtgttcctgaatcatggtttgtattgcccaaaattggatataacaaatttttatcaattgtggaatagatgaataagtgtgatcatttctgtgataaaatacagaatttagaaacaaaatctacctatagttatatggatagattacaatatataatattgagagaaaaaattaaaatgcacaaaggaacacagtataacatttgtataatttaataagatcttgcaaagaacagtactgtgtattggtcatggatccatatatgacttggttgccttttgggatgtgggaaaggtttggtgggagttgttatatttatctgtaatatttctttaataaaagagtgaaagc

SEQ ID NO: 35250 - DNA, 2352 bp, Homo sapiens
tgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgttaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagc

SEQ ID NO: 35251 - DNA, 1918 bp, Homo sapiens
cttctgcaggccccatcccttcccagaaagaagaggaaatgactgagtcccaggagaaatatggggagttgatgagcatcagaaaaaccaggacagacttttgagacaagttgaagttaaattccagaaaacactgactgaagaaaaaggcaatgaatgtcaaaagaaatttgcaaatgtatttcctctgaactctgattttttcccttccagacacaatctctatgagtatgacttatttggaaagtgtttagaacataattttgactgtcataataatgtgaaatgccttatgagaaaggagcattgtgaatataatgaacctgtgaaatcatatggtaatagctcatcccattttgtcattaccccctttaagtgtaatcattgtggaaaaggcttcaatcagactttggacctcatcagacatctgagaattcatactggagagaagccctatgaatgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgtgagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgagaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaagg

SEQ ID NO: 35252 - DNA, 1659 bp, Homo sapiens
atgtttgaacagctgaagccaatcgaacctagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaa

SEQ ID NO: 35253 - DNA, 1980 bp, Homo sapiens
tccccgggagaccctgtgcccctaaatcgcggtccactgcgcgcgtcaggtttctagaagcagggtagaacagacggcagacacctagcccaggctggtgttgttactaaacaatggcagctggtgagccaagggtgaccagggccctgaactcggtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactga

SEQ ID NO: 35254 - DNA, 1980 bp, Homo sapiens; identical to SEQ ID NO: 35253

SEQ ID NO: 35255 - DNA, 1980 bp, Homo sapiens; identical to SEQ ID NO: 35253

SEQ ID NO: 35256 - DNA, 651 bp, Homo sapiens
ggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactga

SEQ ID NO: 35257 - DNA, 1980 bp, Homo sapiens
tccccgggagaccctgtgcccctaaatcgcggtccactgcgcgcgtcaggtttctagaagcagggtagaacagagggcagacacctagcccaggctggtgttgttactaaacaatggcagctggtgagccaagggtgaccagggccctgaactctgtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactga

SEQ ID NO: 35258 - DNA, 1980 bp, Homo sapiens; identical to SEQ ID NO: 35253

SEQ ID NO: 35259 - DNA, 1980 bp, Homo sapiens; identical to SEQ ID NO: 35253

SEQ ID NO: 35260 - DNA, 1980 bp, Homo sapiens; identical to SEQ ID NO: 35253

SEQ ID NO: 35261 - DNA, 1870 bp, Homo sapiens
acaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaa

SEQ ID NO: 35262 - DNA, 1659 bp, Homo sapiens; identical to SEQ ID NO: 35252

SEQ ID NO: 35263 - DNA, 1356 bp, Homo sapiens
gccggcggatcacctgagtctctcctgttcttccagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataa

SEQ ID NO: 35264 - DNA, 1659 bp, Homo sapiens; identical to SEQ ID NO: 35252

SEQ ID NO: 35265 - DNA, 1870 bp, Homo sapiens; identical to SEQ ID NO: 35261

SEQ ID NO: 35266 - DNA, 1870 bp, Homo sapiens; identical to SEQ ID NO: 35261

SEQ ID NO: 35267 - DNA, 1870 bp, Homo sapiens; identical to SEQ ID NO: 35261

SEQ ID NO: 35268 - DNA, 1870 bp, Homo sapiens; identical to SEQ ID NO: 35261

SEQ ID NO: 35269 - DNA, 1659 bp, Homo sapiens; identical to SEQ ID NO: 35252

SEQ ID NO: 35270 - DNA, 1659 bp, Homo sapiens; identical to SEQ ID NO: 35252

SEQ ID NO: 35271 - DNA, 1870 bp, Homo sapiens; identical to SEQ ID NO: 35261

SEQ ID NO: 35272 - DNA, 1659 bp, Homo sapiens; identical to SEQ ID NO: 35252

SEQ ID NO: 35273 - DNA, 1659 bp, Homo sapiens; identical to SEQ ID NO: 35252

SEQ ID NO: 35274 - DNA, 1870 bp, Homo sapiens; identical to SEQ ID NO: 35261

SEQ ID NO: 35275 - DNA, 1974 bp, Homo sapiens
gtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaagggccttatgagtgtagagaatgtgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcacagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactgga

SEQ ID NO: 35276 - DNA, 7861 bp, Homo sapiens
cagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccaaatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctccttcctgggaagaacgtgagttggaaaaatgctgagccagtccctggaaaacctgggtcctggcctggattctgtccttagccagctcttaacaaatcccttaacctcactgtctcctctccttcacaatagagttagtaattcccatccaactggcttcacaggcttttgtgagcttatgaatgtgaaagtattttctagtttataaaacactatatgaatgtggggaaatctttacttgaccttagggcatggagggtggagcacattttgtctgctgtttggacttggatgctgattagcagttatgaagtggcccagacacctagccattctttagtaagagtgaagatagcattttaagccctccttgtgtgcctagcatcttactgaacactttctggtgattctctcctttaatcctcacaaagatctcacagttgtcctccattttacggagaagaaaccgaggctccgagaggttaaacgatgtgcagaggctacctgtagtgatggtgctgagtcaagcctgtcaaccactgtgctcgttagtgaccaaggctgctttgacaggctgccagcttgtcagtggtttgcagccccccagacatttgctttcctacttcccatgcagttggggtgccctgccaagtgccaggttctctttggagtccatctgtgccttgtcaccccaaggagggcctcgagcatcacaccgttgacatttcgaaacgtggtatctctacaacctttcattctcattgggatttaccttgccatttgaacaccatcattttttgaggactgtctagaaaaggttgcctaaccctcacagggaacacacagttccctcagagtccagcatcttctggtcttttctttttcaagatttttttaaatggttgtgctatcatttgtcatcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatattt

SEQ ID NO: 35277 - DNA, 5951 bp, Homo sapiens
ctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccaaatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagcatcgctactgccacagagaactcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtccca

SEQ ID NO: 35278 - DNA, 4248 bp, Homo sapiens
gaggaaaactcacagggtgcgtcgctggtaacccatgctcccataaagcctggcctctggaaagagacttgggaacgagccctgacgttctcagccgtcgagcttcacagagaagggtagctcgaattaggttccttatcttaaagagaataacagcagtcactttctcacaatcttgcgaacgccaaatggaaggatccctcgagagcgctgagaactcgccgagctcctcccgggaaacccggtaccacgaggcgccattttgcggatgggcaaaccgaggcccgcggggccgcgacttacccaggcctttttgcagtgggaggcgacggtggaggagggtggtctgggaccgggacaacaaagtccatcctgccgccggcttcgacgcaggtgccagaaaggtcccaaccccgcccaggcagggcgaggcggcgcggcccaggaacctgtcatggcggcgccgctgcccgacgccggaagtgcccgcctggaactacagctcccagcagaccccgcggcgcgctccggtcgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggagagaaaccttttgaatgtactgaatgtgggaaatcattcagctggagctcccatcttattgcccatatgagaatgcatactggagagaaaccctttaaatgtgatgaatgtgaaaaagcttttagggactactcagcccttagtaaacatgaaagaactcattctggagcaaaaccatataaatgtactgaatgtggaaaatccttcagctggagctcccatcttattgcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgacaacacattgaggaaaaccctataaacataatcaagaggggacatttttcattaagagttcagtaagacttctcccacattatttactagaaaatatcatcttagaagaaaccccatgaaggaaaagaatagggaaaagctttcagcagttatttagcccttactcaaaatcagataattaacaatgaaggaaactctaaactccccttatggtctaccagtaattcatacttgaggaccatgactgtggggaatgaggcatcttttagcaagagctctcaccaattgtagattggtgtgaattgctaagggaaaaaccttatgcagagaaaagtttttgactggaaatacactgttttgcatcaagctggagtactggatggaaaactctacaataacattttgtgcataattgtagaaatacagattttgttgttataaggggagggtctgggtgcccaggagtagaatatgaagtgctaaatctgaatgtaagaaaaataatagtattgaatggggtatttactgttgattaacctccttagagaaaattaatgaatgagatgactaacggtagaaaagttattgcctaggagtgtgagactgatgttgctggacagaaagtgatccttagcccagtgtgtcagcgtccattgttactcatcactgcattgttgggcaattagtttgtaatttgttttaggcaatcactataaattataattatggacactgcatcagtatacataacatgaaggaataaaaaggatacagaattgtatatacatacttactgtaacacatctaaaaaaatgtatatgggtaaggacctgaaagatccatggaaaagttaacccagttgagatttttaaaaagttttacaaatacatataacacttatgtgctgggctttcttttaaatgctttccaagtgttaacttgtttagtcccctttactctgagataggtactgttaccccagttttacaaatggctaagctgaagcagagatgttgaaggatcctacctaaggggcacaactagtaagggagtagagctgagattggctccagagttcttgttttcagccaccattttatgctgcctctccagtgattttttttcccattttcttcagtgtttctatagcagagatttgataataaaaagaaaatcctaaacaatgagaaataaagttacctggtttctctgtc

SEQ ID NO: 35279 - DNA, 2417 bp, Homo sapiens
gtcgacgccggggaagcagccgccattgtccgcggctgaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctggggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggagagaaaccttttgaatgtactgaatgtgggaaatcattcagctggagctcccatcttattgcccatatgagaatgcatactggagagaaaccctttaaatgtgatgaatgtgaaaaagcttttagggactactcagcccttagtaaacatgaaagaactcattctggagcaaaaccatataaatgtactgaatgtggaaaatccttcagctggagctcccatcttattgcccatcagagaactcacacgggagagaaaccatataactgtcaggaatgtggcaaagcattcagagaacgctcagccctcactaaacatgagataattcattctggaattaagccctatgaatgtaataaatgtggaaaatcctgtagccagatggctcaccttgttagacatcaaaggactcatactggagaaaaaccctatgaatgcaataaatgtggaaaatccttcagtcagagctgtcaccttgttgctcatcggagaattcacactggtgagaaaccctataaatgtaatcagtgtgaaagatcctttaactgtagttctcacctcattgcacaccggagaactcatactggagagaaaccatacaggtgtaatgaatgtgggaaagcatttaatgagagttcatcccttattgtacacctaagaaaccatactggagaaaagccctacaaatgtaatcattgtgaaaaagcattttgtaagaattcttcccttattattcatcagagaatgcatagtggagagaaacgctttatatgcagtgaatgtggaaaagcctttagtggtcactcagccctacttcaacaccagagaaatcacagtgaagagaaactgaattgaatttatgcgagtttttcgtttcttgtacatttgaca

SEQ ID NO: 35280 - DNA, 2009 bp, Homo sapiens
gcgctccggtcgacgccggggaagcagccgccattgtccgcggctgaggtgaggcctttgctcaggctgtggggccgccgtagctgcggggcttggggggtcaggagagccggctgggagaggcggcgtcagggtgggtcctgcgcctgccctttccgcgccggctttgcgccgtcgttgccgtcggttctccagccagcagcctgcctccggcctcccgcctccgggcgttcttcgttttctggtcggacgggcctgggtgaactctgctgcacgtcggctccgcgggcctttgtccccgaggccgcgccgggagctcccaagcgcactcctgggccggacctcggcgcgggacaaaagccaaacgccccaggcgggcagaccccgatcctgctgcgccgccttcaagggggaccgccggccgcgagccaggttgggatttgctgtgttcctgggcaggtgcctggtcaatcagtcctcgggatggcagccatcaacccgtgggcctcctggggtgcccttacggaccaatcttgggggatgacagctgttgacccatgggcctcctgggctctgtgtcctcagtatcctgcctggcacgtggagggaagcctggaggaggggaggagggccactgggctcccagcagcccaggttcaggaaccagtgaccttcaaggacgtggccgtggacttcacccaagaagagtgggggcagctggaccttgttcagaggaccctgtaccgtgatgtgatgctggagacctatggtcacctgctctctgtgggaaatcagattgccaagcctgaggtcatctccctgttggagcaaggagaagagccgtggtcagtggagcaggcatgtcctcaacgcacttgtccagaatgggtgagaaatcttgaaagcaaagcattgatcccagcacagagcatttttgaggaagaacaatcccatggcatgaagttggaaagatatatatgggatgatccttggttctccaggttagaagttttgggatgtaaagaccaattagaaatgtaccacatgaaccagagtacagctatgaggcagatggtcttcatgcaaaagcaagtactatcccagagaagctctgaattctgtggacttggggcagagtttagccagaacttaaactttgttccatctcagagagtttctcagatagaacatttctataagcctgatacacatgctcaaagttggagatgtgactcagccataatgtatgcagataaggttacctgtgaaaataatgattatgacaaaactgtttatcagtccattcaacctatttaccctgcaagaatacaaactggagataatcttttcaaatgtactgatgctgttaaatctttcaatcatataatacattttggtgatcataaaggaattcacacaggagaaaaactctatgaatataaggaatgccatcaaatctttaaccagagcccatcatttaatgaacacccaaggcttcatgttggagaaaaccagtataattacaaagaatatgagaatatcttttatttctcatcctttatggaacatcaaaaaattggtactgtagagaaagcgtataaatacaatgaatgggagaaagtctttgggtatgactctttccttactcaacatacaagcacttacactgcagagaaaccctatgactacaatgaatgtgggacgtctttcatctggagctcttaccttattcaacataagaaaactcatactggagaaaaaccctatgaatgtgataaatgtggaaaagtttttaggaatcgctcagcccttacgaaacatgaacggactcacactggaataaaaccctatgaatgtaataaatgtggaaaagccttcagctggaattctcatcttattgtacataagagaattcatacaggagaaaaaccttatgtttgtaatgagtgtgggaaatctttcaactggaactctcatcttattggacatcagaggactcatacaggaga

SEQ ID NO: 35281 - DNA, 4020 bp, Homo sapiens
tcttccggccgtgcggtccgcgcttttgtcccgctggcggccgggttcccgcggcgccgccacagccagttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 35282 - DNA, 1600 bp, Homo sapiens
tgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataagtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtag

SEQ ID NO: 35283 - DNA, 3415 bp, Homo sapiens
cgtgcggtccgcgcttttgtcccgctggcggccgggttcccgcggcgccgccacagccatgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaa

SEQ ID NO: 35284 - DNA, 749 bp, Homo sapiens
ttttttttggtcggtgagtgatgatgataagctcccgctgcaggtgtgaatagagaccccggaggtgcgtcctagccctcatctggggaagcgcacctgcatacagacgggtgcaccggggaggaggcgacctgccgcgtgttcctgcaagcagaaaaggagttaactagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactgggg

SEQ ID NO: 35285 - DNA, 544 bp, Homo sapiens
gtgcggtccgcgcttttgtcccgctggcggccgggttcccgcggcgccgccacagccagtacgttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgt

SEQ ID NO: 35286 - DNA, 542 bp, Homo sapiens
ccgctgcaggtgtgaatagagaccccggaggtgcgtcctagccctcatctggggaagcgcacctgcatacagacgggtgcaccggggaggaggcgacctgccgcgtgttcctgcaagcagaaaaggagttaactaggttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagag

SEQ ID NO: 35287 - DNA, 4010 bp, Homo sapiens
gtgcggtccgcgcttttgtcccgctggcggccgggttcccgcggcgccgccacagccagttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaaacaactcaagccttaaagttcataaaagaatccatactggggagaggccctatgaatgtgatgtgtgtggaaaagcctacatctcacactcaagccttattaaccataagagtacccaccctggcaggacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 35288 - DNA, 2864 bp, Homo sapiens
aactgtccattcagatgggcccgggagaggagggcagggcctgcgcctccctacggagcctttgtttctggcgaccgtccccacccgggctcgcgtctccgtttctccgagaggcccaaggtgtctccgccgcagcctctgtcgcgccgtgacctgtacaggtcgcgggagtcgtagggaggacgccgggacacctggaagccgagaaatggattcagtggcctttgaggatgtggctgtgaacttcaccctggaggagtgggctttgctggatccttcccagaagaatctctacagggatgtgatgcgggaaaccttcaggaacctggcttctgtaggaaaacaatgggaagaccagaacattgaagacccattcaaaattcccaggagaaatataagtcatattccagagagactctgtgaaagtaaagaaggtggtcaaggtgaagaaaccttcagccagattccagatggtattctgaacaagaaaactcctggagtaaaaccgtgtgaaagcagtgtgtgtggagaagttggcatgggtccttcatcacttaataggcacatcagagatcacactggacgtgaaccaaatgaatatcaggaatatggaaagaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcaagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtagacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttaagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatgaccacaaaccataaaggactgtgtgatgtatcagt

SEQ ID NO: 35289 - DNA, 3847 bp, Homo sapiens
ggtgcatggaaggatttttttgcagatgagagggaatcgggattaataaggggaacttgcgaccccgcgtctcgagctggccgtccctggccttgggctcaccggggcctcggcccccaagacctgacaactggagtccgcgaccacaactgggagaactacaactcccaggatgccgcgcaccgcctgcgcccgagctcgacgaggcctcgcacagccaatgggagggtccgggggcgggaactcggagtacgtgcgttgtgacgcaccgacggcgacgtcggggtttgtgtgcgcgagaggccgccgataaaggttgggtgcctcgcgccgggggccgttgggagggagtgcgcccctgccccccctccccggtccccacagctgcaccgccgctgccggggccccaccttcccgtcgacccccgcgggaaggtcctggggctgccaccctcgttcccccgattggggccgcagaggcatgatcaaggacagggttgcctgccaagaacaggaggggagaggaggggctggaggtttcaggagaaagaagcatgtcaggtgtgatggtcggctcccacgcggacatggcgccggcctctactgcggagggggccggggagaagccaggccctgcggcccctgccccggcggcccagtacgaatgtggggagtgtggcaagtcattccggtggtcgtcccggctcctgcaccaccagcgcacgcacacaggcgagcggccctacaagtgcccagactgccccaaggctttcaaaggctcctcggccctgctctaccaccagcgaggccacacgggcgagcggccctaccagtgccccgactgtcccaaggccttcaagcgctcctctctgctgcagatccaccgtagcgtgcacaccggcctgcgggccttcatctgcggccagtgcggcctggccttcaagtggtcgtcccactaccagtaccacttaaggcagcacacaggcgagcgcccctacccgtgcccggactgccccaaggccttcaagaactcgtccagcctgcggcgccaccgccacgtgcacaccggcgagcggccctacacctgtggagtctgcgggaagagcttcacgcagagcaccaacctgcggcagcaccagcgcgtgcacacgggcgagcggcccttccgctgcccgctctgccccaagaccttcacccactcctccaacctgctgctgcaccagcgcacgcacggcgccgcccccgccccgggtaccgcctccgcggccccgcccccccagtcccgggagcccggcaaggtcttcgtgtgcgacgcctacctgcagcggcacctccagccccacagcccgcccgcgcctcccgccccgccgcccccgcccccgcccgtggtgcctgagctctttttggcggcggcggagaccacggtggagctggtgtaccgctgcgatggctgcgagcagggattcagcagcgaggagctgctcctggagcaccagccgtgccccgggcccgatgcggcgccccagccccaggaggcacccgccgaggcgcccaaggccgaccagccaccgtcccctctgccgcagccccctcctcccgccgccgcccccgcgcctggctttgcctgtctgccctgcggcaagtccttccggacggtggctgggctctcccgccaccagcacagccacggggctgccggcgggcaagcgttccgctgcggcagctgcgacggctccttcccgcagctggccagcctcctggcgcatcagcagtgccacgtggaagaggccgcggccgggcgcccgcccccgcaggctgaggctgcggaggtgacctgcccccaggaaccgctggcgcctgccgcccccgtcccgccgccacccccgtccgcccccgcttctgcggagcggccctacaaatgtgccgagtgcggcaagtccttcaagggctcctccgggctgcgctaccacctgcgggaccacacgggcgagcggccctaccagtgtggcgagtgcggcaaggccttcaagcgctcctccctgctggccatccaccagcgggtgcacacgggcctgcgggccttcacctgtggccagtgcggcctcaccttcaagtggtcgtcccactaccagtaccacctgcggctgcactctggcgagcggccctacgcctgcggggagtgtggcaaggccttccgcaacacgtcgtgcctgcgtcgccaccgccacgtgcacactggcgagaggccccacgcctgcggtgtctgcggcaagagcttcgcgcagacctccaacctgcggcagcaccagcgcgtgcacacgggcgagcggcccttccgctgcccgctctgccccaagaccttcacccactcctccaacctgctgctgcaccagcgcacgcactcggcggagcgccccttcacctgccccatctgcggtcgcggcttcgttatggccgcctatctgcagcggcacctgaggacgcacgccccggccaacacgcctcccagcaccacagcccctgccgccggcccccagccccctgctccactggctgctgcgcgggccccgccagccacccaagatgtccacgtcctgccccacctccaggccacgctctccctcgaggtggcggggggcacggcccaggccccgagcttggggccagcagcgcccaactctcagacgttcctcctggtgcaaactgcccagggcctccagctgatccccagcagcgtgcagccccctacacctccgccccctcccgcacctcccaagctcatcctgctgccctcctccagtgctggggctgggggcggccgtgcaaggcagggcccgcgggcagtggggaaagcgggccagggggcgggagtggtctggctgccaggccctgggggtctaggggtgcagggagcggccagcgctggggccagcgggacagggcagagcctcatcgttctgcagaatgtggggggtggggaggcagggccacaggaaatgagtggggtgcagctccagcccctccgaccagccccagaagtaaccacggtccagctccagccagcgcaggaggtgaccacagtccagctccagccagcacaggaagtaaccacggtccagctccagccagcacaggaggtgaccacggtccagctccagcccgtggccggccagctctccaattccagtgggggagctgtggctactgaggcacccaacctgctggttgttcagagcggggcagctgaggagttgctcactggcccgggccccggggaggcgggggatggcgaggccagcactggtgtggtccaggatgtcctctttgagacactccagacggacgagggcttgcagagcgtgctggtgctgagcggggccgatggcgaacagactcgactctgcgtacaggaggtagaaacacttcctcctgggctgacggagccgcctgccaccggcccacccggacagaaactcctcatcatccgcagcgccccagccactgagctgctggacagcagcaacactggaggaggcaccgccacgctgcagctcctggccccaccgccgtcaggcccagcctcgggccccgcggggctccccggggctccagcctcccagatggtgcaagtggtccccgcaggagctgggcctggtgttatgacccctcagggcctgccctccatccagattgtccagactctacccgcagtccagctggtgcacacgttttgaggagaggcagtgattcccctcccgccccgcacagagaccccgactcactgccagccggggcggggcagggtgccgcaggctgggcttgctaataaagacccgagtctccccgcc

SEQ ID NO: 35290 - DNA, 2791 bp, Homo sapiens
ctggtggccgggaacgcccactcacccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggtcctggcgctggcggaatgacgccatttttgttactggtagagctcggcttcgtggctgtttcggagccaccgaaagataagctccctcgtcaccctgacatctctccgggaagactggaagggaaatggcctttcgggggatgttgaacgcatttgggcaggcggggagccaagcccggcttgagagcagagccggggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccctatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaaccccacaaatatggaatcaatttgctcaccctcaaactgtctcagccctcttcacagaataaatgtatctggaagaattagcacta

SEQ ID NO: 35291 - DNA, 2455 bp, Homo sapiens
gagtttgtggggtgatgggggatctgtgcggtgtttgatgatgtctgtaagggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccctatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaaccccacaaatatggaatcaatttgctcaccctcaaactgtctcagccctcttcacagaataaatgtatctggaagaattagcacta

SEQ ID NO: 35292 - DNA, 988 bp, Homo sapiens
cccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagta

SEQ ID NO: 35293 - DNA, 2562 bp, Homo sapiens
cccggacaagtcgcggcccttccaagcctcacactgctttcgtaggatcaattccgaatacccaaactcggagatatcacgaggactcccccgggcccccaaacgcacctctcctctggctggaatgggagcctccagaagcagtgcgagaccacggccagcgacagaggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcatcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccctatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaaccccacaaatatggaatcaatttgctcaccctcaaactgtctcagccctcttcacagaataaatgtatctggaagaattagcactactttggtgttgtttggtcattaaatgctttat

SEQ ID NO: 35294 - DNA, 6505 bp, Homo sapiens
gcatgcgtgcagctctttggaggcggtagcgttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacca

SEQ ID NO: 35295 - DNA, 5281 bp, Homo sapiens
ggcgcgcatgcgtgcagctctttggaggcggtagcgttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaat

SEQ ID NO: 35296 - DNA, 2764 bp, Homo sapiens
ggcgcgcatgcgtgcagctctttggaggcggtagcgttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctggactgctccctacaggcgggggcaacaactacccacagattgtgttggctccaggcctttgtcattaa

SEQ ID NO: 35297 - DNA, 4924 bp, Homo sapiens
atgccccgggacggcgttcctgccgggaataccaccccggcggcagcccaggctgccgcgcagagcccggattccgcgactgccggggcaccgcaggttttggactcgctgaagcggtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaat

SEQ ID NO: 35298 - DNA, 4470 bp, Homo sapiens
ataaatagagcatagaatggaatatgataaatagtgtgacatagaatggaaggtggggcacagatggcacataggaattctgaacctttcttgtaaacatttttaatcctctatttaaaagaatacctatcattctcttcagttttgccttggctttacaacattttaaggattgttttctcttgtttcctttaaataaggattaaccttacctttgtagtcatatatctgaaacctgaaagaagaatatattccaaacttttaaaacaattaaaaacatttttattgtagtaaaatacacaaattttaccgtttgtaagacataaatttaacattttaatcatgtttaagtgtttgttcactgatattcagcaccttcacattgtgcaaccatcaccaccatccatttgtgaacttttgtctcctcaaactgaagttttctatccttttgacaataactcgccattaattcagcccttatcaaccattatttctgtttttataaatttagttacctcatgtatgtggaattatatttgcttttttgtgactggctcatgtcacttagtataatgtctctaaggttcatccatgttgcagcatgtgtcagatttttcttcatttttaaagctgagtaataattctgttttacgcatgtaacacatttttatatccactcatccattgatggacagttgggttgcttctccctttgtctgttgtgaataatgcttctgtgaacatgggtgtacaaatacatgtttaagtatcggctttcattccttttaggtgtatactaaaaagtggaattgttggattatgtggttattctaattccaatttttttaaagaactattcataactttttaatcttctccaaaggcaattcttcagttagatagtcctgaatctgctcagtcaatgtatagctttctgaaacaaaatccacaaaatattggtgaccatatgttgacctgctcattatctccaaagatagacttaccagaggtaagatttatctttcttcagcttttgtgattttagaaaatacagagaacataaaggtcattctcaggtagtagtcaaactgtttctgtgtttagagatgatttttataatttgtgttgcaatcagtgttccaattttcatagtttataaagcagtataaatttgtctaaatgagaataaagaaattttcaacaatgtaacatatatgcatttttgaatacttactgttgacatgtaggtatctacatttttgtgtatagtgactctttgtatgtaacatgattgtctccagaatgcagctactttgaatccattttggcttcctctgggtagaaagaagtttgttttattcttctttttgtttcagttacatttattataaactgtttttgtgttaagaaataagatttcacaggttcttggcctacacagtagtacatgtaggaaagctatggatagtccacctttgaaagcattaaattcaaactcaatctattttctccttctattccattgtatgctgatatcagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacc

SEQ ID NO: 35299 - DNA, 6821 bp, Homo sapiens
gcatgcgtgcagctctttggaggcggtagcgttttcggcgtcgagactggaggctgagtgctaaactgtgtggggcgcggatgggatccagctgttagtcggtattacagcgtgaaataaattcccagtatttttcaagattatgtaaaaggagttgtaattactgctcagcacctaggacagcacccagtgcaacacaatgtacatgaactctggcttgaggtttggggcttgtgttctgcattcaggaaagaaaagaagagaaagtttttgggaaatttaaatcttcgtaagcccttactctaaaagtatatgaaatgcagaatggtttcatggctttatttcaaaatgttttacactggctgtagaacccacttcatgaagtagtttgagttaaaatgatctaatatttgtgttttaactttcagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacca

SEQ ID NO: 35300 - DNA, 760 bp, Homo sapiens
ggaggcggtagcgttttcggcgtcgagactggaggctgagtgctaaactgtgtggggcgcggatgggatccagctgttagtcgggtaggcataggcgaagtttggggccaggaccagaaattgtagtagtttaaaggagtcccgatgaaaaacttgtcaccaggatccagcgatttatgttcaagtactttttccaacgagctctggaattttgcacaaaaaattttctgctttttcccctcatttgttgtaaaggattattttttcagggatgttgtgcttgctggttcagatttacaattaaaaattgataacctggagaaaaggattgaccaaaaaaaggttatttatttcataagatgactatccataaatcttccgatgaacgaacctctttatgaccagagctcctggggttaaaggagaaaggttttataatggctgtcttaatttgtttggtggttttccagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggac

SEQ ID NO: 35301 - DNA, 889 bp, Homo sapiens
gtgcagctctttggaggcggtagcgttttcggcgtcgagactggaggctgagtgctaaactgtgtggggcgcggatgggatccagctgttagtcggctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaa

SEQ ID NO: 35302 - DNA, 731 bp, Homo sapiens
ggaggcggtagcgttttcggcgtcgagactggaggctgagtgctaaactgtgtggggcgcggatgggatccagctgttagtcgggtaggcatagtattacagcgtgaaataaattcccagtatttttcaagattatgtaaaaggagttgtaattactgctcagcacctaggacagcacccagtgcaacacaatgtacatgaactctggcttgaggtttggggcttgtgttctgcattcaggaaagaaaagaagagaaagtttttgggaaatttaaatcttcgtaagcccttactctaaaagtatatgaaatgcagaatggtttcatggctttatttcaaaatgttttacactggctgtagaacccacttcatgaagtagtttgagttaaaatgatctaatatttgtgttttaactttcagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatcta

SEQ ID NO: 35303 - DNA, 595 bp, Homo sapiens
atgcgtgcagctctttggaggcggtagcgttttcggcgtcgagactggaggctgagtgctaaactgtgtggggcgcggatgggatccagctgttagtcgggtaggcatagtgttttgaaatttgtgatggaaaattaaaatggaaggaaaataagtatatagaagatgagaagagaataatggaaaggaaaaagagtgaggaaaagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcaga

SEQ ID NO: 35304 - DNA, 585 bp, Homo sapiens
atgcgtgcagctctttggaggcggtagcgttttcggcgtcgagactggaggctgagtgctaaactgtgtggggcgcggatgggatccagctgttagtcggtgttttgaaatttgtgatggaaaattaaaatggaaggaaaataagtatatagaagatgagaagagaataatggaaaggaaaaagagtgaggaaaagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcaga

SEQ ID NO: 35305 - DNA, 4468 bp, Homo sapiens
ataaatagagcatagaatggaatatgataaatagtgtgacatagaatggaaggtggggcacagatggcacataggaattctgaacctttcttgtaaacatttttaatcctctatttaaaagaatacctatcattctcttcagttttgccttggctttacaacattttaaggattgttttctcttgtttcctttaaataaggattaaccttacctttgtagtcatatatctgaaacctgaaagaagaatatattccaaacttttaaaacaattaaaaacatttttattgtagtaaaatacacaaattttaccgtttgtaagacataaatttaacattttaatcatgtttaagtgtttgttcactgatattcagcaccttcacattgtgcaaccatcaccaccatccatttgtgaacttttgtctcctcaaactgaagttttctatccttttgacaataactcgccattaattcagcccttatcaaccattatttctgtttttataaatttagttacctcatgtatgtggaattatatttgcttttttgtgactggctcatgtcacttagtataatgtctctaaggttcatccatgttgcagcatgtgtcagatttttcttcatttttaaagctgagtaataattctgttttacgcatgtaacacatttttatatccactcatccattgatggacagttgggttgcttctccctttgtctgttgtgaataatgcttctgtgaacatgggtgtacaaatacatgtttaagtatcggctttcattccttttaggtgtatactaaaaagtggaattgttggattatgtggttattctaattccaatttttttaaagaactattcataactttttaatcttctccaaaggcaattcttcagttagatagtcctgaatctgctcagtcaatgtatagctttctgaaacaaaatccacaaaatattggtgaccatatgttgacctgctcattatctccaaagatagacttaccagaggtaagatttatctttcttcagcttttgtgattttagaaaatacagagaacataaaggtcattctcaggtagtagtcaaactgtttctgtgtttagagatgatttttataatttgtgttgcaatcagtgttccaattttcatagtttataaagcagtataaatttgtctaaatgagaataaagaaattttcaacaatgtaacatatatgcatttttgaatacttactgttgacatgtaggtatctacatttttgtgtatagtgactctttgtatgtaacatgattgtctccagaatgcagctactttgaatccattttggcttcctctgggtagaaagaagtttgttttattcttctttttgtttcagttacatttattataaactgtttttgtgttaagaaataagatttcacaggttcttggcctacacagtagtacatgtaggaaagctatggatagtccacctttgaaagcattaaattcaaactcaatctattttctccttctattccattgtatgctgatatcagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacc

SEQ ID NO: 35306 - DNA, 3515 bp, Homo sapiens
gtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcgctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgagtcggtggatcagactcagcagctggtgcccctcgtgaggaacactgcaagggatcacgacggaacccccgaaaatgaaggcgaagagactgtgcagtcagccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagctt

SEQ ID NO: 35307 - DNA, 4544 bp, Homo sapiens
gctggctccgccggccgccggctcccagacgcaagcggagggcggaggggaggggcaggcggcgcccgggagggaggcaccgggccgcgggccaagcctaccgggggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttggggaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgctgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagcagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacatttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatcagatgagtgaatagatttgaatgatttttcccacagggaatcagcctcaaatgttcatgtttcaccccgtcccctttaaataaaaagaatctctgtgttctctttgggcaaaatgtaaaa

SEQ ID NO: 35308 - DNA, 1856 bp, Homo sapiens
gtgggaggcccagtagccagagcggaaaatggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacaggtgagctctgcttcccttggcgtctcctgtggtcccatcactgctgcctttgtattgctttcgcatcagcccattgatgagttggctcacatgatcatcaatggatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactg

SEQ ID NO: 35309 - DNA, 4872 bp, Homo sapiens
gccggagggagctgcggctggagggagggacgcctggcttcccggggcggctggtgggggctcggtcacccataggggctgggaggaggatcggcgcgtcttccgggttgctgcctttcccgggggtctgccccgctgacattctgtgcccgcctctcgccctgtctccccgtgcccatcgcaactgtcaggccctgcgggctcccgccgctgtcactcgcgcacaggttaccccgtggctccctttctcttcacttgctcatgccccagctcatgggaaacctgttttctgacctcacttcccctgctccagttctgccttgctcggattctctgaaatctgaccctttccaggggcactgtgacaagaagaagggaagaagcaaccttacccctgagcaggctcccgtcccgcccatgccctacccgtggcaggggccagggttctctgatggacggagccaactcgtccgtgtgcccttgggctactcatttttataacatggccccttttctgttcatcagcactggctgcagaaacttccttttgcaggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttggggaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgctgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagcagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacatttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatca

SEQ ID NO: 35310 - DNA, 1823 bp, Homo sapiens
gctggctccgccggccgccggctcccagacgcaagcggagggcggaggggaggggcaggcggcgcccgggagggaggcaccgggccgcgggccaagcctaccgggggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaa

SEQ ID NO: 35311 - DNA, 575 bp, Homo sapiens
ctaccgggggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgcaagctgaggacaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaata

SEQ ID NO: 35312 - DNA, 555 bp, Homo sapiens
aagtgactcctcctcagtgctctctcaagccctttatcctatcgtgaaaactagagggtacgctccttgaggaattccagactgttgtctggagaaatcgctctcggcctcggtctggcctgtaacgggcggttacgcaattccaggtaattgacgaaccctgaggacagaactccgtgggaggcccagtagccagagcggaaaatggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggagga

SEQ ID NO: 35313 - DNA, 556 bp, Homo sapiens
ggggcactgtgacaagaagaagggaagaagcaaccttacccctgagcaggctcccgtcccgcccatgccctacccgtggcaggggccagggttctctgatggacggagccaactcgtccgtgtgcccttgggctactcatttttataacatggccccttttctgttcatcagcactggctgcagaaacttccttttgcaggtcccttgctacccatatgtgtgaagaaaagggggaaatgaaagccctagaacccacactgcagtgggcatgggatcatcctggaaccaggagaaacgaggtcacaatttgggtctgcagcagaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacact

SEQ ID NO: 35314 - DNA, 5683 bp, Homo sapiens
ccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttacc

SEQ ID NO: 35315 - DNA, 2036 bp, Homo sapiens
cggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtttgatttaattttggatgagatcgttcttgcagcaagatgttaataagacaaaatctagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaa

SEQ ID NO: 35316 - DNA, 1253 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaag

SEQ ID NO: 35317 - DNA, 5698 bp, Homo sapiens
gcaatgcactgagtaacggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaatt

SEQ ID NO: 35318 - DNA, 2056 bp, Homo sapiens
tgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgtttgaatgagatgatgcaaaatgaagaaaaatatgaaaaaatcttaaaggcattgaa

SEQ ID NO: 35319 - DNA, 1903 bp, Homo sapiens
gcaatgcactgagtaacggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgccc

SEQ ID NO: 35320 - DNA, 3226 bp, Homo sapiens
gaagagaagcccatgtcccatcgtcctagcgcggcagaattgactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtggggtatcaagccggcaaacctgatgccctcaccaagttggaacaaggagaaccactatggacactagaagatgaaatccacagtccagcccacccagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacagaggagagaaaccccacgggtgtagcttgtgtgggaaagccttctacaagaggtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttatatctttcatatctttatttatcatggttttacttttaacctatttatgctttcatatttaaagtgggtgtttagtgggcaacatacagttgggccttccttttttatccagttaacaatctctgtctttttactggggtatttagatcatttacgttcaatgtattgatgtttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcacttactgtataataaaataatcttacagt

SEQ ID NO: 35321 - DNA, 3857 bp, Homo sapiens
atgcgtggtgcgtgtgtgaaggggggtgcagcgcgcggtcccggggtcccggaggggagtgcgcaggcgctgagtccctgctcggctgtctcggtggtcgccgccggggtctgagcccgggaagaccgagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatc

SEQ ID NO: 35322 - DNA, 4052 bp, Homo sapiens
atgagaacattggtcaatgcattgtccggtggaggacaagagataaagccagaaggcaaatgtgctcacaatggaatgtgtttccgctgtgaagaagtggcacctgatacatgtgaagcatacccctaccccggtttagtggtgagtgttgctggaaaagagggtcccaatccagaccataagagagggttcttggatcttgcacaggaaggaattcaagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgaactggtcactgttgccttatttagttcatttggtgaggtcatgttttcccggatggtcttgatgcttatggatgtttgtcagtacctggtcattgatgaattagactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatc

SEQ ID NO: 35323 - DNA, 972 bp, Homo sapiens
aaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaagaatccttttaaatgcagaaaatgtgggaaattatttaataggatttcacccctgatgcttcaccagagaattcacacttcagagaaaccgtacaaatgtgaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaa

SEQ ID NO: 35324 - DNA, 3768 bp, Homo sapiens
gcggtcccggggtcccggaggggagtgcgcaggcgctgagtccctgctcggctgtctcggtggtcgccgccggggtctgagcccgggaagaccgagccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctggctggactacaatgatggcatgatctcggctcactgcaacctccgcctcctgggttcaagcaattctcgtgcctcagcctcccgagcggctgggattacagactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattgg

SEQ ID NO: 35325 - DNA, 4459 bp, Homo sapiens
atgcgtggtgcgtgtgtgaaggggggtgcagcgcgcggtcccggggtcccggaggggagtgcgcaggcgctgagtccctgctcggctgtctcggtggtcgccgccggggtctgagcccgggaagaccgaggttccagccgtcctcacctcaggaggacatagctttgtgcctttcaaagccctttctcatctatcatcagggactcggaagacgagccaggtttacagccctgccttgatgtgtagtgccgagttccttgaagaaaattattttatggacaatgtatgagtctgttttcgtgctgctgataaagacatacccagactcacagttctacgtggctggggaggcctcacaatcgtgatggaaggtgaaagacacgtcttacatggccacagggagaatgagagtccctgtacagaaccatcagatcacatgagacttactcactgccatgagaacagcatgggggaaaccgcccccatgattcagttatctcccaccgggtccctcccacaacacgtggaaattatgggagctataattcaagatgagatttgagtggggacacagccagaccatatcagacaagaatcatcttctcaaatttggggtgcgtggctgagtgcacacacctgtgaaaactgcgggatgaatgcattacaacttcctggaacaagtcattttacctaagtaattggaaggggaaagccaactgatctgcttatctgccctgccttaccagctctctgcccatctctcagtgtggaccctaaagggggaggaaaggatgccttctgcacgggggaaatccaaatccaaggcacctataacatttggggacttagccatctacttctcccaggaggagtgggaatggctgagccccattcagaaggatttgtatgaagatgtcatgttggagaattaccggaacctggtctcgcttggtctttcctttcggagaccaaatgtgatcaccttattggagaaagggaaagcaccctggatggtagagccagtaagaagacgccgggctcctgactcggggtctaaatgtgagaccaagaagttacctccaaatcaatgcaacaaatctgggcaaagcatctgccagaaactagtttctgcacaacaaaaagctcctacacgaaagagtggctgcaacaaaaattcagtcctagtaaaacctaagaaagggcattcagggaagaaacctttaaaatgtaatgactgtggtaaaacctttagtcgaagcttctctcttaaacttcatcagaacattcatacaggagagaagccttttgaatgcagtaattgtagaaaagctttcagacagatctcatccatcctacttcatcagagaattcacagtggaaagaaaagccatgaatgcaataaatgtggggaaagcttcaatcaaagaacaacccttattctacatatgagaattcatgatggaaaggaaattcttgactgtgggaaggccttgagtcaatgtcagtctttcaatatacatcagaaaattcatgttgttgggaatgtctgccagtgcagaaagtgcggaaaagccttcaatcagatgtcatcccttttacttcataagaaaattcacaatggaaagaaaacacataaatataataaatgtgggagaggcttcaaaaagaaatcagtctttgttgtacataaaagaattcatgctggagagaaaatccctgaaaatgcgaaggccttaagtcagagtctacagcaaagaagtcaccatttagagaatccttttaaatgcagaaaatgtgggaaattatttaataggatttcacccctgatgcttcaccagagaattcacacttcagagaaaccgtacaaatgtgataaatgtgacaagttcttcaggcggctttcaacccttattctgcatctaagaattcataatggagaaaaactatacagatgcaataaatgtgagaaggtctgcaatcggcattcatcccttattcaacatcagaaagttcatacaaagaaaaagaaactatttgagtgtaaggaatgtgggaagatgttttctggaactgcaaaccttaaaatacatcagaatattcattctgaagagaaacctttcaaatgcaataaatgtagtaaagttttcggccgccaatcatttcttattgaacatcaaagaattcatactggagaaaaaccctaccagtgtgaggaatgtggaaaagccttcagccaccgaatatctctcacacgacataagagaattcatactgaagatagaccctatgaatgtgatcagtgtgggaaggccttcagccagagtgcacacctcgcccaacatgaaagaattcacactggagagaagccatatacatgcaaaacatgtggtaaggcctttagtcagcgcacatctcttattctacatgaaagaagtcatactggagagaaaccctatgaatgtaatgaatgtgggaaggcatttagcagtggctcagaccttattcgacatcagagaagtcattcttcagagaaaccctatgaatgtagtaaatgtgggaaggcatatagtcggagttcatccctgattcgacatcagaatacacattctgaagaaaaagcctaaggttgttttaaatctataaaatcaacgaatgaggctatcaaacatatggcaaatatgtatttgtctataatgtaaattttgtgtatatgggaccatttgatgatatgtcccactttgaaagccaaagagcaaaagtcattggtgattttgacctcaggatttgaaattaactgaaggaaactcagaagtttggtcagtcattgtgaatgaagatcatttttcatttgataagaattactggctgggcgcagtggcttacacctgtaaccccagcactttgggaggctgagacaggcggatcacgaggtcaagagtttgagaccacggtgaaaccctgtctctactaaaaaatacaaaattagctgggcgtggtggtgcgcacctgtaatctcagctactggagaggctgaggcaggagaatcgcttgaacccaggaggtgggggttgcaccgagcagagattgcaccactgcactccagtctgggcaacagagcaagactctgtgtcaaaaaaaaaaaaaattaccgatattttacttccagcatagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatc

SEQ ID NO: 35326 - DNA, 2274 bp, Homo sapiens
ggtcagagtgcagacctgagaccactgctcaccgatttcagactccagtttatctgtgcctcggcttccccacttagtcgcagaagacttaggctgaggccccaggaagagatctccatcctttgcaggagcacaacaagatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggcatctagttgggaagccagatgtgatcttcaggttgggaccaggtgacgagtcctggatggcagatggagggaccccggtacggacctgtgcagtctgggaagttgacgagcagatagatcactacaaggaaagccaagacaaatttctgtggcaagctgcattcataggcaaggaaacactgaaggatgaaagtggtcaagaatgtaaaatatgtagaaaaatcatttatctcaacacagactttgtttctgtaaaacaaagactccctaaatattattcatgggaaaggtgttcaaaacatcatttaaactttcttggtcaaaatagaagctatgtaagaaagaaagatgatggatgtaaggcatattggaaagtatgcctccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacatcaacgaactcatacaggagagaaaccatttgtatgtgacaaatgtccaaaagcctttaagagttcatatcatcttattagacatgaaaaaacacacattagacaagcattttataaaggtattaaatgtactacgtccagccttatatatcaaagaattcacacaagtgagaaacctcagtgcagtgaacatgggaaagcctctgatgagaagcccagtcccactaaacattggagaactcatacaaaagagaacatttatgagtgtagtaaatgtgggaaaagcttcagaggaaagtcacacctctctgttcatcagagaattcatacaggagagaaaccctatgaatgtagtatatgtgggaagactttcagtggaaagtcacacctctctgtccatcatagaactcatacaggagagaaaccttatgaatgcagaagatgtgggaaagcctttggggagaagtcaacccttattgtacatcagagaatgcatacaggagagaaaccctataaatgcaacgaatgtgggaaagcctttagtgagaagtcaccactgattaaacatcagagaattcatacaggagagagaccctatgaatgcactgactgtaaaaaagccttcagtaggaagtcaactctcatcaaacatcagagaattcatacaggagaaaaaccttacaaatgtagtgaatgtgggaaggccttcagtgtgaaatcaactctcattgtgcatcacagaactcatacaggagagaaaccttatgaatgcagagactgtgggaaagcattcagtgggaagtcaactctcattaaacatcagagaagtcacacaggagataaaaacctatgattatacttgagagtgggataattatactagtagttatttgtcatttgactattactagtctcattatttgtcaaataatcatggcgagtaatcttataaatgtccagaatattggaaattcttcatatgttaatgttcatttaacttaatacaaagtacaaaagtataattccagaggtgtcaataaatgtgatcagttttttcacccagaattcttcacccaggagtgaagaactgtatgtcaaataattcaaaaggggcaaaactgaatgtagttatgtgggaaagccttcagaaataatttaaatggcactgtttatcagagtatgtatgccgaggaaaactaagaatttagtgagcttataaaaccatggtagccaggcgtggtacgtagctcacacctgta

SEQ ID NO: 35327 - DNA, 4073 bp, Homo sapiens
ccggagggtggcgcttcgttcacactggctgttgtcatccgcccctgaggtttcaggctgtcggcagtgaaggtcagagtgcagacctgagaccactgctcaccgatttcagactccagtttatctgtgcctcggcttccccacttagtcgcagaagacttaggctgaggccccaggaagagatctccatcctttgcaggagcacaacaagatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggcatctagttgggaagccagatgtgatcttcaggttgggaccaggtgacgagtcctggatggcagatggagggaccccggtacggacctgtgcaggtgaggacaggccagaagtctgggaagttgacgagcagatagatcactacaaggaaagccaagacaaatttctgtggcaagctgcattcataggcaaggaaacactgaaggatgaaagtggtcaagaatgtaaaatatgtagaaaaatcatttatctcaacacagactttgtttctgtaaaacaaagactccctaaatattattcatgggaaaggtgttcaaaacatcatttaaactttcttggtcaaaatagaagctatgtaagaaagaaagatgatggatgtaaggcatattggaaagtatgcctccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacatcaacgaactcatacaggagagaaaccatttgtatgtgacaaatgtccaaaagcctttaagagttcatatcatcttattagacatgaaaaaacacacattagacaagcattttataaaggtattaaatgtactacgtccagccttatatatcaaagaattcacacaagtgagaaacctcagtgcagtgaacatgggaaagcctctgatgagaagcccagtcccactaaacattggagaactcatacaaaagagaacatttatgagtgtagtaaatgtgggaaaagcttcagaggaaagtcacacctctctgttcatcagagaattcatacaggagagaaaccctatgaatgtagtatatgtgggaagactttcagtggaaagtcacacctctctgtccatcatagaactcatacaggagagaaaccttatgaatgcagaagatgtgggaaagcctttggggagaagtcaacccttattgtacatcagagaatgcatacaggagagaaaccctataaatgcaacgaatgtgggaaagcctttagtgagaagtcaccactgattaaacatcagagaattcatacaggagagagaccctatgaatgcactgactgtaaaaaagccttcagtaggaagtcaactctcatcaaacatcagagaattcatacaggagaaaaaccttacaaatgtagtgaatgtgggaaggccttcagtgtgaaatcaactctcattgtgcatcacagaactcatacaggagagaaaccttatgaatgcagagactgtgggaaagcattcagtgggaagtcaactctcattaaacatcagagaagtcacacaggagataaaaacctatgattatacttgagagtgggataattatactagtagttatttgtcatttgactattactagtctcattatttgtcaaataatcatggcgagtaatcttataaatgtccagaatattggaaattcttcatatgttaatgttcatttaacttaatacaaagtacaaaagtataattccagaggtgtcaataaatgtgatcagttttttcacccagaattcttcacccaggagtgaagaactgtatgtcaaataattcaaaaggggcaaaactgaatgtagttatgtgggaaagccttcagaaataatttaaatggcactgtttatcagagtatgtatgccgaggaaaactaagaatttagtgagcttataaaaccatggtagccaggcgtggtacgtagctcacacctgtaatcctagcacttttgggaggctgaggtgggcagattgcttgagctcacaagtttgagaccagcctgggcaacatggcaaaactctgtctctacaaaaaatacaaaagttatctgagtgtagtggtgcatacctttagtcccagctactcaggaggttgaagtaggagggtggcttgagcccaggaggcagaggttgcagtgaactgagatcgtgccactgcactccagcctgggcattatagccagaccttgtcaaataaataaataaacaaacccatggtataaatgagaggaatcatgctctatattcttttattaatagagacagggtcttgctatgttgcccaggctggtcttgaactcgtagcgttaattgatcctcccacctttgcctcccaaagcacttgtattatagatatgagccaccacacttaccatgttctttaccaaacattttgtggaagaggtgtagaggtggcaaacaattataaatttaagatatgttcactgtggagtagagtatgattatttatttatttagagatggagtttcgctcttctcgcccaggctggagtgcagtggcacgatcttggctcactgcagcctctgccttccaggttcaagtgattctcctgcctcagcctcccaagtagctgggattacaggcacccaccaccacacccggctaattctttttttttttttttttttttagtagagacgcagttttgccatgttgggcaggctggtctcgaactcctgacctcaggtaatccgcccgcctcagcctcccaaagtgctgggattataggcgagagccaccacgctcagtgagtatgacatttttaaaagaacagtataaagcataaaatatcccatgtggggcaaactcccagattattttcctaaacaaatagaaaaaatgcttcctgaaatagggtaagagaggatgagtcatcaggatccctgaaacaaagatctcaaacaggagaccttacgtatattattcatcaatatcttcagtgcaaaaatgcaaagccattacagaaagggcacatagtaagcttttacatactttccttaggaacagtgcttagaacttaaaattctccatgttttaataaagagtaataattttatggtgaagcaatataagatttaaaattttcagagtatcttccataacagcagtattatttaaagtagtgaaaaaataagacaatttaatatccaatgatagatgattaaaaattggtatgtcaggtgaaataacatgcaccaattaagactactggcaaatttgggaaaatgttcgtggtaaatcattaggtaaaaaatattataaaacaataaccatatgattaatattgtacaaacaggaagtatatgaaccattatatcagtgattctgggtggttgacatataaaaattttgtgatgagtaaagttatatgcacatataagtataaatttgtatttatttaagtataaatttgtattcacctatttcataggtgagtgtgtgtgtatagataaacacatggaacaaaaagttaggtatatctgtgtagtgtggagggaaaaagctaggaaagaaatacaccaaattattaagtaaattggcatttgaatgtggggattattgatgtgtaaaaatttttttgattgtagtctccagaaatcaccaataaagtatatcgtttaaagtg

SEQ ID NO: 35328 - DNA, 5378 bp, Homo sapiens
ggccgcggggagggcggcggtggctgcagcggctggagcggggtagagaccgccgggtctcggcccgcaccaggagcggaacaacctttcagatctgtgtggaccccagaagatccgtgaagaatatgaattgattccatgcggacatgaatgagtccttaaacctagaacatcatgtacatcatcctccttaataatagtattgattatttggttctatgctggggaccggaggggatgagatggtttccaccagaatgctcactgagctctattacccttccctgttccctgtattttttttttttttctgagacagtcttgctctgtcgcccaggtgggagtgcagtggcacgatctcagctcactgcaaactccacctcccaggttcaagcaattcttctgcctcagcctcccgagtagctgggactacaggtgtgtgctgccatgcccagctaatttttgtatttttagtagagacggggtttcactatcttggccaggatggtcttgatctcctgacctcgtgatccgcccgcctctgcctccccaagtgctgggattacaggcgtgagccaccatgcccagccccctatatttcttttttttgagacagggtctcgctctgtccaggctggagtgcagtggcgtgatcttggctcattgaaacctcaacctcatgggttcaggcgattctcctgcctcagcctcctttgtagctgcgattacaggcatgtgccaccacacctgtctagttttttgtatttttagtagagacaaggtttcaccatgttggccaagctggtctcaaactcctgacctcaagtgatccatctgcctcagcctcccaaaacgctgggattacaagcatgagccaccgcacctggccccttccctgtatttctaagaactctcttttcccctgctttctctggattttggagcccaccaaggtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctc

SEQ ID NO: 35329 - DNA, 4556 bp, Homo sapiens
gagggagtggggaggccgaaccggagagaagcaggaagtagcggcggccgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctcca

SEQ ID NO: 35330 - DNA, 4568 bp, Homo sapiens
cgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcagaagcaagggccctggccttcgggctgtgccgctgctgccatcctgtcctctcccatttcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctcc

SEQ ID NO: 35331 - DNA, 3277 bp, Homo sapiens
gcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcagaagcaagggccctggccttcgggctgtgccgctgctgccatcctgtcctctcccatttcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattaatattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctc

SEQ ID NO: 35332 - DNA, 1438 bp, Homo sapiens
ccggtctttccagccccgagagggacctggttcctctgcccaggcttctgtcactctgtcacctacgctatgccctgctgtagtcacaggaggtgtagagaggaccccgggacatctgaaagccaggaaatggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccataaaaaaatctcactctgtcacccaggctggagtgcagtggcatgatctcaggtcgctgcaacctctgcctccagggttcaagcaactctcctgcttcagcctcctgagtagctgggactacaggcatgcaccaccacgccaggctaattttttgtattttttagtagagacagggtttcaccatattggccaggctggtcttgaactccagacctcatgattcgcctgcctcggcctcccaaaatgctgggattacagatatgagccatcatgcccagccgcaaccctaatttttcattcagtcataataccaacagttatctcatgtacctctgagtgccttcttcccaaaagccagcagtaccatacctgctgtcagcaagtgtgtaatataccatagtgataaatatgaccaaaagccataaatgactgtgagatgtatgagaatgacacgtcacattagtaagaagagaaaaattttggccatgtttatgatttgaaatatgttttcctctatcacatttagaaatatagttacaaaatgcccttagttttatcctgattcatcatggtcactgaggagcatcgtctcatatgcctggtatgtgacatgtgtctcttcaacagtaaaagacttggcattggctgggcatggtggctcacgcctgtaatcccagcactttgggaggccgaggtcaggagttagagaccattctgaccaatatgatcaaaccccgtctctactaaaaatacaaaaattagcggggtgtggtggcatgctcctgtaatcctagctattcaggaggctgacgcaggagacttgcttgaatataggaggcagacgttgcagtgagccgaggtcacaccattcactccagcctgggcaacaagagcgaaactccgtttcaaaaaaaaaaaaaa

SEQ ID NO: 35333 - DNA, 2010 bp, Homo sapiens
tgttcctccagacactgagggggtcgcattccttacctcacctttgtccctgcgcgggctgcggctgggatccggtctttccagccccgagagggacctggttcctctgcccaggcttctgtcactctgtcacctacgctatgccctgctgtagtcacaggaggtgtagagaggaccccgggacatctgaaagccaggaaatggacccagtggcctttgatgatgttgctgtgaacttcacccaggaggagtgggctttgctggatatttcccagaggaaactctacaaggaagtgatgctggaaactttcaggaacctgacctctgtaggaaaaagttggaaagaccagaacattgaatatgagtaccaaaaccccaggagaaacttcaggagtctcatagaaaagaaagtcaatgaaattaaagatgacagtcattgtggagaaacttttacccaggttccagatgacaggctgaacttccaggagaagaaagcttctcctgaaataaaatcatgtgacagctttgtgtgtggagaagttggcctaggtaactcatcttttaatatgaacatcagaggtgacattggacacaaggcctatgagtatcaggaatatggaccgaagccatgtaagtgtcaacaacctaaaaaagccttcagatatcacccctcctttagaacaccacaaagggatcacactggagagaaaccctatgcttgtaaagaatgtggaaaaacttttatttcccattcaagcattcaaagacacgtggtaatgcacagtggggatggaccttataaatgtaaattttgtgggaaagccttccattgtctcagtttatatcttatccatgaaagaattcacactggagagaaaccatatgaatgtaaacaatgtggtaaatcctttagttattctgctacccttcgaatacacgaaagaactcacactggagaaaagccttatgaatgtcagcaatgtgggaaagcatttcatagtcccagatgctatcgtagacatgaaaggattcacacgggagagaaggcttatcaatgtaaggaatgtggaaaagcattcacgtgtccccagtatgttcgtatacatgaaaggacccactctaggaaaaaaccctatgaatgtacgcagtgtgggaaagcattatcctctcttacaagttttcaaacacacataagaatgcactctggagaaagaccttatgaatgtaagatatgtgggaaaggcttttgttctgccaattcatttcaaagacatgaaaaaactcacagtggagagaaaccctataaatgcaagcaatgtggtaaagccttcattcattccagttcccttcgttatcatgaaaggattcacactggagagaaaccctatgagtgtaagcaatgtgggaaggccttcagatcttcctcacaccttcaattgcatggtaggactcacactggagagaagccctatgaatgtcaggaatgtgggaaagccttcagatctatgaagaaccttcaaagtcatgaaaggacacaaacacacgtaagaatacactctggagaaagaccttataaatgtaagctatgtgggaaaggcttttattgtcccaaatcattgcaaagacatgaaaaaactcacactggagagaaactctatgaatgcaagcaatgtggtgaagccttcagtagttccagttcctttcgataccatgaaaggactcacactggagagaaaccctataaatgcaagcaatgtgggaaagccttcagagctgcctcagtccttcgaatgcatggtaggactcaccctgaagataaaccctatgagtgtaagcaatgagggaaagccttcagatctgcctcacacctttgaatgcatggtaggacacacaatcaagagaaaccatgaatgtaaagaatgtgggaaacccttcaggtctgcccagaaccttcgaattcagtaaaggacacaagcacacataagaatgcattctggatagctgaacaaa

SEQ ID NO: 35334 - DNA, 2250 bp, Homo sapiens
cggaagtttgcggggcggggcggacgcgggtggccaaggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaactt

SEQ ID NO: 35335 - DNA, 2242 bp, Homo sapiens
cgtttccggcggcgtcgcgcgtttgcgagcctcgggtggtcctcagggagggtctctcggccagaacacgtggatgcccacccaccactgagcctcatgggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaactt

SEQ ID NO: 35336 - DNA, 1874 bp, Homo sapiens
cgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtgctaaccataatgctgtgttcttttcactaacagcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgtgcacagtgtccctgggcttggtgatgcccaagcgtcttcatggagcctctggcggctttcttgctgcagcagtgtttaccacaccagccaagtcaccttgaacttggaaaatgacttcatgccctccagccactgaaggattatttttcctctcagcccttagtggtttctttacctaaatgtcacggtacaactgagaataaggcagctgggtcagttcaatagaagtaaacctaaagtccaacaatccaggttagatattagccacggagggatgggaggaggagtcttctttttttttgagacggaatctcgctctgtccctcaggctgaagtgcagtggtgcggtctcggctcactgcaagctccgccacctgggttcacgccattctcctgcctcagcctcccgagtagctgggactacaggtgcctgctaccacgcccggctaatttttttgtatttttaatagagacggggtttcactgtgttagccagctggtctcgatcttctgacctcgtgatccgcccgcctcggcctccctaagtgctgggatgacaggcgtgagccaccatgccgagctgaggaggagtcctcttctagctgcacgatgtggaaatgacacatcatgtccatggggcagcttgctgagagccaagggtgtgagcacatgacttaaattcaagctactgcacagctttgagatctgagtatcacatggaagcatccaggtggcccctggcacacaggctggtggttcttttgtggagagggagaggaagaggggctgctcatggggtagtgcaggtgctagaatatcctgttaacctgttcacactgcactgcaattcgggcttcggtaagctcatctaaagagtttccaggccaggcacggtggctcacgcctgtaattccagcactttgagaggccaaggaaggatcacgtgaccccaggagttcggagaccacagtgagctgtgatcgcaccactgcactctagcctgggtgacagagtgaggccctgtctccacaatatataaataaaaacattttgggtttctgttttggagacaataaattaaatctataacctag

SEQ ID NO: 35337 - DNA, 2905 bp, Homo sapiens
gcgcggcgggcgcggactcgggttgccctcggtccgagtgatccctggtcgcttccttagccctcccgccttcggcattggggtccccgcgtcccccgggcctccaggcgggaaagcgcgggggctttgcggggccttgagcgcctggtgtgggaggtggtcgagcccagccaccctcccccgcggcggcgcgaggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaacttacttattttatatggaatcgtttatactgacaaacatgtagaatgttggtaaaggttcagaattgctctcaagaatatccaacttcaggccgagtgtggtggcttatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcacctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgcta

SEQ ID NO: 35338 - DNA, 2082 bp, Homo sapiens
cgtttccggcggcgtcgcgcgtttgcgagcctcgggtggtcctcagggagggtctctcggccagaacacgtggatgcccacccaccactgagcctcatgcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaactt

SEQ ID NO: 35339 - DNA, 3123 bp, Homo sapiens
gcggtcattgtcctggcagagcggcgagccggtgagtgtggctgcggggtcgcgcccaccctctacctgtgccgggggccggaacctggccccggggagggcgcggcctcggggagacggcgtgcaggcccagcactgttggtcaccgcaggcctgtcttcctattcaccgtgggcagcagagggatggctgctcagctgctgactgatgaggcactgactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggggttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacggcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatac

SEQ ID NO: 35340 - DNA, 2887 bp, Homo sapiens
gccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctaatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagctt

SEQ ID NO: 35341 - DNA, 4124 bp, Homo sapiens
cggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcactt

SEQ ID NO: 35342 - DNA, 4255 bp, Homo sapiens
agacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagttgcgctgaaatagcagatgaagtttacatggaagtcattgtaggggaagaggaaggaacttctctccctgagattcagcttgaggactctgatgttaataaaacagttgtccctgttgtctgggctgcggcatatggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcactt

SEQ ID NO: 35343 - DNA, 2278 bp, Homo sapiens
tactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagttgcgctgaaatagcagatgaagtttacatggaagtcattgtaggggaagaggaaggaacttctctccctgagattcagcttgaggactctgatgttaataaaacagttgtccctgttgtctgggctgcggcatatggagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaat

SEQ ID NO: 35344 - DNA, 8390 bp, Homo sapiens
agagtgaagcggaaggcttccgggttttgcggggcctttgtctctgcagccggagctccaggtcttgtcttcactgctgtgtgtcctctgctcctagaggcccagcctctgtggccctgtgtcctgcaggtattgggagatccacagctaagacgcccgggagcccctggaagcctagaaatggggccattgcaatttagagacgtggccatagaattctctctggaggagtggcattgcctggacactgcacagcggaatttatataggaatgtgatgttagagaactacagaaacctggtcttccttggtattgttgtctctaagccagacctcatcacctgtctggagcaaggaaaaaaacctttgaccatgaagaaacatgagatggtagccaacccctcagttacgtgttctcattttgcccgagatctttggccagagcagagcataaaagattctttccaaaaagtgacactgagaagatatgaaaactatggacatgacaatttacagtttaaaaagggctgtgaaagtgtagatgagtgtaaggtgcacaaaagaggttataatggacttaaccaatatttgacaactactcaaagcaaaatatttcagtgtgataaatatgtgaaagtcattcataaattttcaaattcaaacagacataagataagacatactggaaaaaaacctttcaaatgtatagaatgtggcaaagcttttaaccagtcttcaacccttactacacataagaaaattcatactggggagaaacccttcaaatgtgaagaatgtggcaaagccttcaactggtcctcacaccttactacacataagagaattcatactggagagaaacggtacaaatgtgaagactgtggcaaagcctttagccggttttcataccttactgcacataagataattcatagtggagagaaaccctacaaatgtgaagaatgtggcaaggcctttaagcgctcctctaaccttactacacataagataattcatactggagagaaaccctacaaatgtgaagaatgtggcaaggcctttaagcgctcctctatccttactgcgcataagataattcatagcggagagaaaccctacaaatgtgaagaatgtggcaaagcctttaagcacccctctgtccttactacacataaaagaattcatactggagagaaaccctacaaatgtgaagaatgtggcagagcctttaagtacttctcatcccttactacacacaagataattcatagtggagagaaaccctacaaatgtgaagaatgtggcaaagccttcaactggtcctcacaccttactacacataagagaattcatactggagagaaaccctacaaatgtgaagaatgtggcgaagcctttaagtactcctcttcccttactacacataagataatccatactggacagcaacccttcaagtgtgaagaatgtggcaaggcctttaagtgcttctctatccttactacacataagagaattcatactggagagaaaccctacaaatgtgaagaatgtggcaaagccttcaactcgtcctcacaccttactgcacataagagaattcatactggagagaaaccctacaaatgtgaacgatgtggcaaggcttttaagcgctcctttatccttactagacataagagaattcatactggagagaaaccctacaaatgtgaagaatgtggcaaaggctttaagtgcccctctacccttactacacataaggtaattcatactggagagaaactataaatgtgaggaatgtggcaaagctttaagctatcccactatgcttttttcacataagaaaattcatattggagggaaactgtacaagtgtgataaatgtggcaaagcctttatttcatcctcaaaccttagtagacattagataattcatgcgggaaagaaacccaacaaataagaaaatgcagcaaagcctttaaggacacctctgcccttactagacataagataattcgtactggagagaaaccctgtgagtttgatgaatgtcggaaagcctttaaccagctatcaacttttactaaatatgagaatttatatggaacataaaccctacaaatataaagaatgtgacaacgcttttaggaagttctgaacccttcttacacataattcatgctggacaaaaatcctacaagtttgaggaatgtggcaaatcctataacaagttttcaatatttttttttttgagatgaagtttcatgcttgtcatccaagctggagtacagtgccatgatctcggctcactgcaacctctgcctcctgggtttaagccattctcctacctcagcttcctgagtagctgggattacaggtgtcctccaacatgcccagctaatttttttatttttagtagagatgcgacttcgccatgtttgccaggctggtctcgaactcctgacctcaggtgatccacccaccttggcctcctaaagtgctgggattacaggcgtgagccacgacgcccagccacaagttctcaattcttaagaggcatggcaataattcatgttgaagaggaaatccgcaaagctaaaaaatgtgacattgcttttacgaacacctccaacttctctacacataacaataattatactagtgtgaaaccctagaaatatataaaatgtgacaaagcctttatatggttgccactcttgattgtaggttggataattcatactggcaaaactcctacaagtgtgaagaatgtggcaaaacttttaatcagttcttacaccttatctcacagaaaagctagtatccttgagaaaaattgtacaaatagaaggaatatggaaaacctattaattcctactcacatctaactcaacataaaaatcttccttttaataaaagcattaaaatggcaattactgtcaaaactttcagcaagtataagcctttaaagtgaagaagagtatttattgtgaagacaagcattacaaatataaagggagttacatagtacatttactagtatcacagatcttattgcacacattttgtactggaggaaaatcctaaagcagttgctcaagtttgttcaacatcagggaatttatattggagatgagtcctacaaatgtattaagtttagaaacacttttttttccccagaaactacagcttagaaaacaacagagagtttatgctaaaatataattttgcagatgcagtaaatattaaaaaatatttaattcaaaatagattgtatataaatatcaagagagtttacagtagaataactaaggccccgacacttcagacattacactaaatcagagcattgaatataaaaactaatccacaactgcagtttttaggtaaatgatttctatttaactttaaaaggagtagatttttggaagcattgtaattacgttgaaagtatacttgtttccttgaataaaattttttgaaagctgaataatgatgtaatacagctttcaaattatgctgttattttatttctattcacatgtgagaaagcatgtgatcagtggcttctgcatcagagatattcgatttttttacattatttggacattatgactttttctataaaatagtaagaacattaaaatgtaagacgcataatgaaaatacaagtggagaagctgtttgtagtaaaattctattaagtaatgtataacgtaaatgttcagagcaatactttattatagtgacacaaagaaataattaaaagtatattaaaataaatgagtatattactttactacttgtacttttatgtaataaaatgcagtgcattttaaaactgttagggccgggcttgatggctcatgcctgtaatttcagcactttgggaggccaaggtgggcagatcacctgaggtcaggagttcgagaccagcctgaccaacatggagaaacccagtctctactaaaaatacaaaaaaaattagccaggcatggtggtgcatgcctgtaatctcagctactcaggaggctgaggcaggagaaacacttgaacctgggaggcagaggttgcagtggggcaagattgtgcgattgcactccagtctgggcaacaagagcaaaactctgtctcaaaaaaaaaaaagtttgttagattatttgtgaacttaattttattttatttttaccatggtaagactaccgtgcgtttaatgaaccattattgtgccactaactgtatcccactttactcaagggtgtaggtacaatattgtaggaatatactatttcatacattgtaaaataacatctttagtaatcactgtcagtggctttaaactgcaaatgagttaaatattgttcccatagattaaattttgactctttattatttaaattttttatttgtattcgtgggtatataatatgtgtatatatttatgccttatatggcatcttttgactcaggcctacaatatgtagtaattacattatggtaaataaggtatccatcacctctagcatttatcttttgtattaccaatagtgtaattatatgcttttattcattttaaaatgtacaattaaattgttattgactacagaattatttctatgatcataataattatacaaaaatgtaaataaaatacggccaggcacagtggctcacatctgtaattccagcactttgggaggccgagacaggtggaatgcttgaggttaggagttcaaggccagcctggccaacgtggtgaaaccttgtctctactaaaaacacaaaaattaggcatggtggcacatgccaggaggctgaggcaggagaatcgtttgagcccaggaggcagaggttgcagtgagctgagatcatgccactgcactccagcctggctgacagagtgagtctccatctcaaaaaataaaataaaaataaaatccatacatttctgagtcctgaaaaattataaatacttgtaatatagttttccttgaacatgtggtctctgcctgcaaacacatagacttttagttttaatttacatagagttaaatatacacatattactctgaagataaacctgaggtgtaagaaaattatgaattgagtgtttttgtgtgagtataggtttgtacatattttcagaataaaagcaattactgcaacaaaacaaattatgttatttaggtgattaacaaaactaaacacttttaaaatggtgaaagcaaatctatactttctgctttgtattgaatttattaatataaaatgttctggcctgtgattcggattctccccagagtctgcctattaaagcacaggcaactttgtctccagaaacaactctcttgagtacaataataaaagccctcttaaaacaggaaaaaaaaatcatttttaacacttatttgaatgaacattcaaccaaaattgaataattggatatatttttattgttctatgtgtgtgtgaatgtataaatggtgcataaaaaataatttaagccagaaaaatagttatttgtaatgaataaaactaaaaagtagttaattattatatccagttgatatctttgtttatgtagataacaaaagcagcagaaagactctttttttttttccatgatggagtgttgctctgtcttccaggctggagagcagtggcgtgatctcagctcatggcaacctccacctcctgggttcaagcaattctcctgcctcagcctcctaagtagctgggattacaggcatgcaccaccacgtctgactaatttttgtatttttagtagagacagggtttcatcatgttggccaggctggtcccaaactcctggcctcatgatctgcctgcttcagcctcccacggtgctggtattagaatcatgagccaccgtgcccagcaaaagatgattttaaacatttatttaggtgggtaggcaacattctaagataataccctggattaccagtctgttgcacacgtgctgtgtcatactttcctcttgagtgtaaaaaaaatgtgtgactgtggtgggaaatcacttatgaaattaggttactcatccgtagactttgtgtttatcaaaatggagattatcctgattgtgctaaacttaatcagaggtgcttttaagagaaagagacacatcacagaaaaacacccctgctggcctgaaagtaagtgacttctaggtagaacatgttgtaagctgcttatggtggccacatggcgggaaaaatgtttgtatcttgccatcatttctgcctcctccatgttgcttccagtaaggaacataagaggattctatggcagagggaaaaaaaagggaatctcattcattcaagaaataatcacctctcatctgggatagcttaagagaaacaggagaccacaacaggtccacattaatgggaggaaaaaggtaacctgggtaaaagtgctcactggcattatggaacagtatttagtaagctgtagtgaatgatcagcctctgggataccaatagtctaccaacaaggctgaactcattctaattcaatcagcatgtctgcaccattctggtgacacaggtttacactatttattacagaaatgccatgaagaccagtgggtaatgtcctaaaattgaacttacttcaaaaagtatacctaattgtctgttttcatatttgaaaaaccttaaaaacaatgaatttataaataattaacttctaattatagaggattctactatactgtaatacaagattaaactgtaaacacattaatatgaatattttttgaatccatgattagttatgtagatagtttcttttagattcacatgaccaaggtaacattagagaaaacatttgaaatggaataaaatttaccaagaccacattttttcaatggcttcgcataattgccgtacttacagaaatggccagatgactaacaagaaacaaaggcaagatttaagctttgctcaatgattgtttttgaccttttgaaatctgaaatcctggctaaagtattcaaagggagtattttataggggcttcccagggtttccaagtaattgaagaaagaatttcttttttttttttttagaaggattctcactctgtcactcacgctgcactgcaatggtacgtgctcagctcactgcaacctccacctccctggttcaagtgattcttccgcctcagcctcctgagtagctgggataacaggcacccgccattatgcccggataatttttgtagtagagatgggatttcatcatgttagccaggcttgtcttgaactcctgacctcaggtgatccatccacctcagcctcccagagtgctgggattacaggcatgagccacttttcccagccagaataattttggtaggcaggaaaatgcacattatgtacacacattgctcttctctgatttgctttaacactgaaaaactgaagattgtaaatgtagtctcaatttagagtgaattaacaaaagatttgtttttcaaaaaagcaaatgtataaaattaatgggtaacagatgccattagttgctaaaaaatagtatgactaaagttggtaattatctagctatgcaaataacagcccaattaaattaagactctattgggtgcatgtggaaagcattgatgtgcagtgtggtgcctccactcagcatttccttactgtctctttacagagataccaattccccctgaattactcagggtccataatggttttagaaatgtttgttctctggagctgtaaagaaatagcacttgaaaataaatttaatttttcttagcaaggccatttttactttttgcagaaagcagttttgccacgagtacactgaacagaggagacagagtcatttataacttgacgtgtccaccctactgctgtgtctggttttcattggctggaatgggacctcacattctgtatgtcccaattgtttagcaacttagaactttttaaaagagacaaaggcagaggagaacaaaggaaggaggaagtaacttgtggaatgctgagaaaggtaaaaataccttcaaataaggaggaggaacaggctatgacctaatgcttgcttggattagtataagcatgccagggcaaatatttaggctaaattgtgggagctaagaacataaagtacattgattttttaattgtgcttagcagatatttaagaatgttagcacaggtctttgaataaactttgcttctaagagaagttactattcataattaggtagaaaagtctttgaagaggaacctctacttcactttttacactgtgaactgagaatgctgtgttcagagtgattactgaaaacatggttaatacacttcttccatatgataataaaatgttataaatctt

SEQ ID NO: 35345 - DNA, 2503 bp, Homo sapiens
cttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcggggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaa

SEQ ID NO: 35346 - DNA, 3159 bp, Homo sapiens
gtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgacta

SEQ ID NO: 35347 - DNA, 1839 bp, Homo sapiens
atggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaa

SEQ ID NO: 35348 - DNA, 3744 bp, Homo sapiens
ggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaagagtttggctcttgtcacccaggctggagtgcagtggcgcaatcttggctcactgcaacctccacctcttgggttcaagcaattctcctgacctcaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttga

SEQ ID NO: 35349 - DNA, 3806 bp, Homo sapiens
gtggggctgtgcggccgcgctgcctccaggaagcctcacgggccttcgtctgccgggccgcggcgccggctcccaggatgcagtgtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccgatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggagtggggcaagctggaggactggcagaaggagctctacaagcacgtgatgaggggcaactacgagacgctggtctccctggactacgccatctccaagcccgaggtcctctcccagattgaacaagggaaggagccctgcaactggcgccgccctggccccaagattccagatgttcctgtggaccccagtccaggctcggggcccccagttcccgccccagacctcttgatgcagatcaagcaggagggtgagctccagctccaggagcagcaggccctgggcgtggaggcgtgggcagccgggcagccagatattggggaggagccctggggcctcagccagctggattccggagcaggagacatctccacggatgccacctctggtgtccattccaacttttccaccaccatcccgcccacctcctggcaaacggatctccctccccaccatccctcttcagcatgctcggacgggaccctgaagctcaacacagcagcctccacggaagatgtaaaaattgtaataaaaacagaagtccaggaagaggaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccacgtgtgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcccgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtcactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctggcagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcaccaa

SEQ ID NO: 35350 - DNA, 3797 bp, Homo sapiens
gcggccgcgctgcctccaggaagcctcacgggccttcgtctgccgggccgcggcgccggctcccaggatgcagtgtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccgatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggagtggggcaagctggaggactggcagaaggagctctacaagcacgtgatgaggggcaactacgagacgctggtctccctggactacgccatctccaagcccgaggtcctctcccagattgaacaagggaaggagccctgcaactggcgccgccctggccccaagattccagatgttcctgtggaccccagtccaggctcggggcccccagttcccgccccagacctcttgatgcagatcaagcaggagggtgagctccagctccaggagcagcaggccctgggcgtggaggcgtgggcagccgggcagccagatattggggaggagccctggggcctcagccagctggattccggagcaggagacatctccacggatgccacctctggtgtccattccaacttttccaccaccatcccgcccacctcctggcaaacggatctccctccccaccatccctcttcagcatgctcggacgggaccctgaagctcaacacagcagcctccacggaagcagatgtaaaaattgtaataaaaacagaagtccaggaagaggaggtggtggccacacccgtacatcctactgacctagaggctcacgggaccctgtttggaccaggccaagccacacggttcttccctagtcctgcccaggaaggagcctgggaaagccagggcagctccttccccagccaggaccctgtgctggggctgcgagagcccgcccggcctgagagggacatgggtgagctcagtcctgctgtggcccaggaggagacccctcctggggactggctcttcggaggggtccggtggggctggaatttccggtgtaaaccgccagtgggcctgaacccgaggacggggcccgaggggcttccttactcctccccggacaacggagaggccatcttggaccccagccaggccccaaggccattcaacgaaccctgtaaataccctggccggaccaaaggctttggccacaagccagggctgaagaagcaccccgcggcgccccccgggggccggcccttcacctgcgccacgtgtgggaagagcttccagctgcaagtcagcctgagcgcgcaccagcgcagctgtggggcgcccgacgggtcgggcccgggcacaggcggtggcggcagcggcagtggcggcggcggtggcggcagcggtgggggcagcgcacgggatggcagcgcccttcggtgtggggagtgcggccgttgcttcacgcgccccgcgcacctcatccgccatcgcatgctgcacaccggcgagcggcccttcccctgcaccgagtgtgagaagcgcttcaccgaacgctccaagctcatcgaccactaccgaacgcacacgggcgtgcggcccttcacctgcaccgtctgcggcaaaagcttcatccgcaaggaccacctccgcaagcaccagcgcaaccatgcagcgggcgccaagaccccggcccgaggccagccactcccgacgccgcccgcacctcctgatcccttcaagagccccgcctccaaaggacctttggcctccacagaccttgtgaccgactggacttgtggcctcagcgtcctgggacccaccgatggcggggacatgtgagcgcctccagccccatagcccctgccggccgcacgtgtaaaaagccccgtgtgcaggcagcagggcggcgtggaagcttcaggcagacgcgggacggggagaaccaaatgtccaagttgctgaactgatgatcactggagaaagagaaactatccaccaggacagctgccacctctaaaccaagtagaattctctgtgaaatgggagcgccgtagaattttaagtaatttaattgcaaacctgttttgttttttgttttttgtttttttttaattcttgaggaaaaagctggaaaatagtaatagggctatttaaattttgtaggtacttttggttttcagggcgtgcatttctgtcactatctcactgagtctgatagtgtgttggaaggttggccagttggggacccctggcccactgactcctggggatggggtcctgtgtgtgcccctgctctgcccagttgggctgagtgggcctagcgcaccaagcccctgggcagtgagggccattgggtcccttggagcacacctcagtgcagcaggaaggacccctccgggagtagcggttgcatttcccagcttgcctctcctgaaaaggccccccaaaagtgctggccccaacttttctctattttgggccatctgtggtacccgtcccaagggcacttggtggtgtcccctagtgtgtgactccctggcctcataaggacgagttgtctgaaatcccagcgttaggtctggggagatggagaagctgaaactggggagctgcaccacaaacgtctagctctcagcagagctgggagcaaagcctggccgcccaccccaacctggggctgcctcccactccgtgagatgcttctgtctcctgttcactttgtgtggtagtttcttattttcaaaatgcatctcatttgatcattactgtgaccttgggaagcagcaggacagggatttctttttagaggtgcaaactgctcagaggggacacacctcagcctctcactgtgggtacacgtggcgtgccatgagtggggaagagcaacaggcgagatgcctcattctactggaacatcactgtgggtgaacagagatttccaggttttccctcttaaaatatttgtcccacaccgacaagagtccagtcaccaggcctcaaaggaacttctgcttgtagcagccgcctcccctgtgccccagcctccttaatgtgtgcactctcagagggcacagctcgcgaggctgggtttgggggccaagtggcttgttcattccagcatctaacatcataaaggtgggcccagatttcttgattcgaccacagtgctgttcctaccacacaaatatccattcctgttttgttgaagcagccactggtcctcttgtttcccctgcagacggagggacctggcagtgcccattcattcagccccctcatgcatacttttattaggcgatagactagttaagaaaattgtttctatgtactgtatattttgtacctgtttacacttctaatattgatataactgatattttgaaaaataagagaaaacatcctgttaaaataaaacctaaccagcacc

SEQ ID NO: 35351 - DNA, 3190 bp, Homo sapiens
acttaaatccctcccactggaacagcaggctccagtttcacccagcaagcgtgagaacaggtactgcttcctgagcaccgccagccaccggcaccaagaccggccacatcccagcactgcccacctctgctcccagccgccagatgacggaggctctcgccagaccctcagcacgcagagctggcttctgatagaagtgatcgggaaagaaagcaaagcgggaggtgcctctttagaaaccacgaagtgcacgcggcgtcgacagtgatcacgccacctggacagccagagtccaaggcataaggaggaaaatgagtctcctcaaagagcggaagccaaaaaagccacattacatccccaggcctccaggaaagcccttcaagtataaatgtttccaatgtccctttacttgcaatgagaagtcacatctttttaatcacatgaagtatggtctttgtaaaaactcgattactttagtatcagagcaggatcgagttcccaagtgccctaaatctaactcactagaccccaagcaaaccaaccagcccgatgccacggcgaagccagcctcttccaagtctgtcgcaaatggactctctgccttcgactcgaagcttcagcacagctctgccagggaagacatcaaggaaaacctggagctgcaagcccggggaacccacaggtgcctgggacagaagccagccctccacagggcatcaccctgcaagagcccagctccggaagccgccctcggtgcccagcctgctctggaaggcgcagctcggccttctgcatttgttccagtcggcgagcacagactcaaggggccagacaacgccgaggcgcccgagacactggctttacacaaccccactgccaaggccgtgtctttccacaccaagtcggccttccacactcctggctacccctggaaagccggctcacctttccttccaccagagtttccacataaaatctcatctacaaaggggcttggggccatttccccttacatgcaccccacaatcccagagtacccgcctcacttttacacagagcacgggctggccaccatctactcgccttacctgctggctgggagctcgcctgagtgtgacgcacccctgctgtcagtctacggaacccaagacccgagacacttcctgcctcacccggggccgatccctaagcacctggctccatctccagccacatacgatcactacaggtttttccagcaatatccctctaacctgccgattccttacggattttacaggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggatgggccccctcaacctctccaagaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcctgccttccccggtcgaccacgagctgcagaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaacaaaaaaccctccaattcagtttttataaatattaagcatgaatattaaaaggtgcttctacttttggttgtaaaaacacctgaatgactctaagactgatatgtattttcaagtctaagctgtcttacagaagatcttttataaatgtttccttataaatatctcaccattacaacaaattgttttaactgtttttctattagctctagctgcatatttgatgtaaatgacaattactgaaaaaatgtcagaaaaaacattttcagtactaacattaaagtgccatatgtaaaaaagaaaaatgtgatttgtataactaaataacacacaaacatcaagaggctatttatacaaataatttatttccactagggaaagtgcattactggtgaaggtattatcaatttattctacttgcttataatgttacagtgaatgttctggcttactctgcctcactttccattccccaaaatgatgtgtatgttgctaattttccaataaactcatatgaaccataaggaaacataaaatgcaaataaacataaatctatgttatccttt

SEQ ID NO: 35352 - DNA, 2459 bp, Homo sapiens
acttaaatccctcccactggaacagcaggctccagtttcacccagcaagcgtgagaacaggtactgcttcctgagcaccgccagccaccggcaccaagaccggccacatcccagcactgcccacctctgctcccagccgccagatgacggaggctctcgccagaccctcagcacgcagagctggcttctgatagaagtgatcgggaaagaaagcaaagcgggaggtgcctctttagaaaccacgaagtgcacgcggcgtcgacagtgatcacgccacctggacagccagagtccaaggcataaggaggaaaatgagtctcctcaaagagcggaagccaaaaaagccacattacatccccaggcctccaggaaagcccttcaagtataaatgtttccaatgtccctttacttgcaatgagaagtcacatctttttaatcacatgaagtatggtctttgtaaaaactcgattactttagtatcagagcaggatcgagttcccaagtgccctaaatctaactcactagaccccaagcaaaccaaccagcccgatgccacggcgaagccagcctcttccaagtctgtcgcaaatggactctctgccttcgactcgaagcttcagcacagctctgccagggaagacatcaaggaaaacctggagctgcaagcccggggaacccacaggtgcctgggacagaagccagccctccacagggcatcaccctgcaagagcccagctccggaagccgccctcggtgcccagcctgctctggaaggcgcagctcggccttctgcatttgttccagtcggcgagcacagactcaaggggccagacaacgccgaggcgcccgagacactggctttacacaaccccactgccaaggccgtgtctttccacaccaagtcggccttccacactcctggctacccctggaaagccggctcacctttccttccaccagagtttccacataaaatctcatctacaaaggggcttggggccatttccccttacatgcaccccacaatcccagagtacccgcctcacttttacacagagcacgggctggccaccatctactcgccttacctgctggctgggagctcgcctgagtgtgacgcacccctgctgtcagtctacggaacccaagacccgagacacttcctgcctcacccggggccgatccctaagcacctggctccatctccagccacatacgatcactacaggtttttccagcaatatccctctaacctgccgattccttacggattttacaggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcctgccttccccggtcgaccacgagctgcagaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaa

SEQ ID NO: 35353 - DNA, 2069 bp, Homo sapiens
ttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgtt

SEQ ID NO: 35354 - DNA, 2347 bp, Homo sapiens
ttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaatccctgccttgcaatgtcagtaggataaagcagctataaaaattagtacttgcccaaggcctgaaagagaattagtgggaattaagatcaacttctcagttttgtttgtttactttttaattggcttttctttgttgttaagaatgagagacttaatttccatgggagttggagtgtgtgtgctgcaggcaggatcctgtggctcatttggcatggagacctggacatgtagtcagcaggagacggttccctaaataaaagatttgggcactggtg

SEQ ID NO: 35355 - DNA, 2977 bp, Homo sapiens
agaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgagagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatc

SEQ ID NO: 35356 - DNA, 5592 bp, Homo sapiens
gatacaatggtgtcgttcgggaaacgcagccctaacgttggtcctaagctgacaaattggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagtttcgccatgggtgactttggcctgagatgcgctccatggagcagattctggagttgctggtgttggaggagttcctgactatcctgtcccaggacatccacagcagggtgcagaagctgcaacgggcgagctgtgaagaagctgtaactcttttaaagtatatgtatgacttttaaaagagagagcttgtgaaactgagggaataggtgagtgagagagaggttttatctgccatcttcctcaaggaggcccagcctcccctttattcatagggttctgggtctggtgggtccagaggactgagacatctcgctgtcttaattccccattcagattttcttgattgccctgagtagaccttacacgggccagtgattttttgttgttgttgttgttgttgtcttctctggaaccttcatcctccagatttccccccagtgcagtgaagagtgtgctattgcttttggtttccacggggaggcagtgtcgctgtcatagtgtccgctctggaggtagatcaaagggggctttcaactcctggctctgctccctactagctgtgcgactttgggcaagtgacttttgcttggctgggcttcactttctgcactggtcaaatgcagaaagggtaatagacccttctggggttgtttggaggattaaagggagagcagtatgtccgtaataatcgcactgctggcacacagctagtgcttgaaactgtgagctgctgttaggttaggggcagcagtctggtctcctctgcagagatgggtctcagttaattgtgaacttaaacagtttggcactgaggctttggggtcattgccccagggccacccaagtaagcttgtctaattgagaggaacaggagcagctggagaatgtgggggaggaaccgaagacctatgggggacatgtgtgtactgaaatgggctttctccccacaccctccacacaagcacatacacacattcactctgggtcatggcatcataaaaaccttgagtttaaaccatccctttctcttgttgggtccaaatggacagactctggttttctattgaagatttacacgcagattcctgtcataatttttcttttctatcgagccctgtcatgatgataagtgatagcaggttggttcctagatcatacaccatggacctagcacagaagtgttttcagaagagccttttccttacaaaacagcatgaaagtcattgagccaatggatactgagatttcaaactggagccaatggatacttagaggagccctgaagtgtagagtagttgctacttcttgttcactaggtctaattagcatgtcatcagtgtaacagactagtgtgttgtcttgtgaaagagaaaggtgataagatccctgtgaactaaactatgatgtagggcttgaaaattgatatacaatacgcctgaggtaggatggcgaaggtgtattcctggtcttaccagctgaaagtaaattgcttctggtggtctttactaacagttattgagaaaaaaagcattttcaaggtcaagaggtacatactaggttccaggggatatgttaatttgctcaagaaatgaaaccacatctggaacagcagctgcaattggagtcatcacctggcttagtttacaatgacccactaccatcttccaagatccatctgccttctgcataggccaaacaggtccacagaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagctgtgcatgatcaacagatgttagccctttctgagcagaaaagaatcaaacactggaagatggcatctaaactcatcctgcctgagtccctgagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactc

SEQ ID NO: 35357 - DNA, 2447 bp, Homo sapiens
ggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttc

SEQ ID NO: 35358 - DNA, 2716 bp, Homo sapiens
ggcgcgccaagaggaaaggaaagtgcggcggccctggaacctggatatcgcgcgaggcaagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttcca

SEQ ID NO: 35359 - DNA, 2000 bp, Homo sapiens
aagctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggatt

SEQ ID NO: 35360 - DNA, 2575 bp, Homo sapiens
ctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttc

SEQ ID NO: 35361 - DNA, 1928 bp, Homo sapiens
atgcgtcaccccggccttggtgggggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacaccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctca

SEQ ID NO: 35362 - DNA, 1373 bp, Homo sapiens
ttccctgggcgctcagcctcgctggccatgcgtcaccccggccttggtgggggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacaca

SEQ ID NO: 35363 - DNA, 2039 bp, Homo sapiens
aagccgagttcccctctgccttgcgcgcttccccgcctaccccgagcggctcaggtgtcctgtcgtgctcacctgcgccggtcgctggaccgcggggcgctaaccctggagagcccaggagcgggcgggacatggactgcgtgatctttgaggaagtggctgtgaacttcaccccagaagagtgggcattgctggatcatgctcagaggagcctctacagagatgtgatgctggagacctgcaggaaccttgcctccttggattgttacatttatgttagaaccagtggatcaagttctcagagggacgtttttgggaatggaatatccaatgatgaagagattgtaaagttcacaggaagtgattcctggtctatttttggagaaaattggagatttgataacactggagatcagcaccaaatcccacagaggcatctgagaagtcagctggggagactctgtgaaagtaatgaaggtcatcaatgcggagagaccttgagccagactgcgaaccttcttgtgcacaagagttaccctaccgaagctaaaccctctgagtgcactaagtgtggcaaagccttcgagaatcggcagagatctcacactggacagagaccgtgtaaggaatgtgggcaagcctgcagctgcctctcctgccaaagccctcctatgaaaacgcagactgtagagaaaccctgtaattgccaggactcaaggacagcatctgtgacatacgtgaaaagtctcagcagtaaaaagtcttatgaatgtcagaaatgtggaaaagctttcatttgtccctcatctttcaggggacatgtgaatagtcatcatgggcagaaaacccatgcatgtaaagtatgtgggaagacctttatgtattactcctaccttacacggcacgtaagaactcacacaggagagaaaccctatgagtgtaaggagtgtgggaaagccttcagctgtccctcatactttcgagaacatgtcagaacacacactggagagaaaccgtatgaatgtaagcattgtggaaaatcattcagctgttactcctcctttagagatcacgtgaggacgcacactggagagaaaccctgtcagtgtaaacattgcggaaaagcgttcacttgttactcgtctcttcgagaacatgggagaacgcacagtggagagaaaccctatgaatgtaaggaatgcggcaaagccttcaggtacccctcctctctgcgagcacacatgagaatgcacaccggagagaagccctatgtgtgcaagcagtgtgggaaggccttcggatgtcccacttactttagaagacatgtgaaaacacacagcggggtgaagccctatcaatgtaaagagtgtgggaaagcctacagtttttcctcctcccttcgaatccacgtgaggacgcatactggagagaagccctttgagtgtaagcattgtgggaaagccttcagctgtcactcctcccttcgagagcatgtgcgaacccacagcggagagaaaccgtacgaatgtaatcaatgtgggaaagccttcagccacgctcagtactttcaaaagcatgtgagatcacacagtggggtcaaaccctacgaatgtactgaatgtgggaaagcctacagttgttcctcgtcccttcgtgtgcacgtgagaacgcacactggagagagaccgtatgaatgcaagcagtgtgggaaaaccttcaggtatctcgcatcgcttcaagcacatgtgagaacacatgctggagcgtgaatctacgaatacagtggacctgggagagtgttcaaccgtaaaaccttgttgtaaatgtgagaaacgttatttatgtagagcatgtaggaaaacctggtatagcacttattttgtacctaaaaattcagagtaggagagaaatctcttaattatgattaatatggtattgcctttacatgcctcagccttaatagtgattccttttgtattaatttctagtgtatgtttgtgatataaacatttaataaatatcctgttttgtacgctttc

SEQ ID NO: 35364 - DNA, 1305 bp, Homo sapiens
agactctgtgaaagtaatgaaggtcatcaatgcggagagaccttgagccagactgcgaaccttcttgtgcacaagagttaccctaccgaagctaaaccctctgagtgcactaagtgtgggaagacctttatgtattactcctaccttacacggcacgtaagaactcacacaggagagaaaccctatgagtgtaaggagtgtgggaaagccttcagctgtccctcatactttcgagaacatgtcagaacacacactggagagaaaccgtatgaatgtaagcattgtggaaaatcattcagctgttactcctcctttagagatcacgtgaggacgcacactggagagaaaccctgtcagtgtaaacattgcggaaaagcgttcacttgttactcgtctcttcgagaacatgggagaacgcacagtggagagaaaccctatgaatgtaaggaatgcggcaaagccttcaggtacccctcctctctgcgagcacacatgagaatgcacaccggagagaagccctatgtgtgcaagcagtgtgggaaggccttcggatgtcccacttactttagaagacatgtgaaaacacacagcggggtgaagccctatcaatgtaaagagtgtgggaaagcctacagtttttcctcctcccttcgaatccacgtgaggacgcatactggagagaagccctttgagtgtaagcattgtgggaaagccttcagctgtcactcctcccttcgagagcatgtgcgaacccacagcggagagaaaccgtacgaatgtaatcaatgtgggaaagccttcagccacgctcagtactttcaaaagcatgtgagatcacacagtggggtcaaaccctacgaatgtactgaatgtgggaaagcctacagttgttcctcgtcccttcgtgtgcacgtgagaacgcacactggagagagaccgtatgaatgcaagcagtgtgggaaaaccttcagttggccctcggaccttagggttcacatgagaacacactctggggaaaagcgctgtggatgcaaacagtgtggaaaatccttcagttctccctcctcctttaagggacacataaggactcacactggagagaaactgtacacctgtagggaatgtgggaaagtcttcagtagtccctcatacttccgaacacaagtgagaattcacattggagagaaaccctatgtgtgtgagcagcgtgggaaagtcttcagttggtcatcatcttttcgaggacatttgagaactcacagtagagagaaaccctacgaatgtaaggagtgtacaaaagccttc

SEQ ID NO: 35365 - DNA, 2078 bp, Homo sapiens
aatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagtactgccttccccaggccctgcccttccccaagaggaaaacacaggagaggaaggaatggctgctggtctcctcacagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgta

SEQ ID NO: 35366 - DNA, 1965 bp, Homo sapiens
acagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagatgagaaaaatgagacttagagaggttacgtgatttgcacactgctgctgagtggtggatcatggatacttgagagtctgtgaacactctaatgcctccctacatctgatactgccttccccaggccctgcccttccccaagaggaaaacacaggagaggaaggaatggctgctggtctcctcacagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaaca

SEQ ID NO: 35367 - DNA, 2210 bp, Homo sapiens
gttgtagtcgccgcgtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggaaccagtgaccttccgggatgtggctgtggactttacccaggaggaatgggggcagctggaccctacccagaggatcctctaccgtgacgtgatgctggagacctttggtcacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgtagagtaacgtgt

SEQ ID NO: 35368 - DNA, 1289 bp, Homo sapiens
attgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggtaacaataacaacaataacgacggcggcgggctccgggcaagcgtctcccgcgcagactgaccctttcacctcgcggcgcgatgagagcggcaccgctgttaatgcccttgacacgtggggaaactcagacgcgggtcggggcgtggtgaccgtcctggctggtcagagagggggccgggattccaaccaggcgcctggcccccgaatgcgcatgctccacgcggctctgtcctccccagcaccgcggagcccctgccctggggcttgggcacaacctcttgggggcaatgatgggtcaccacgcactgagtgtgatgagagtgaccaccagggtcgtcccctgcgagactgtgggagaactgcagtgcagggcggtcagtgtttgcagggccatctggccatcagagctccactttctagacaaagtggttgcggcctgtgttctccataaagctgcctcgcgtggcaggaaacaacaataattatccttcctcaagctctgcaactttgaaattatacttttttttattttttgtcgttggtttgttcatggggatttgcattatttcagatttggtacacaaagtgagacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaaggtagaaactgtaacaccttccatgacctggattcagaattcacactcttgtcacttccacggtgtcttactggttac

SEQ ID NO: 35369 - DNA, 1364 bp, Homo sapiens
attgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggaaccagtgaccttccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagca

SEQ ID NO: 35370 - DNA, 2555 bp, Homo sapiens
gccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttggctgcagtctcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgttagaa

SEQ ID NO: 35371 - DNA, 2939 bp, Homo sapiens
gccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttggctgcagtctcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaaggtacaaaggccttgcctcgttatttgtcctttatatgtattcactcctgtctacaggagaattgtcctctgtaaagattaactctgtaaagatttattgaatgcattctttgttctaaaacattgtactcctgaggaatgtaagtctttgtgagaaatatgaacgcttaagtaatggaatatgtgaaacttgtaagaacgtagaatataaaaatactgccatataaaatcctttcatatctgaggaggtaagtaaccacattgaatgggcatattttgctacatcatttaagactacttaaggctttaatttaacaaaaaacaattcttcatgtggttttgaacacccagtgctcaatatacttgtttgttttgatttattttctcagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgtt

SEQ ID NO: 35372 - DNA, 4690 bp, Homo sapiens
ggccgcgggtcccggcggcggggtgggcgggggaggcagcgggtgacagatgtactcctctgacagctctcagtatcagcccagtggctccctgccattggctcagtgcaatggaccggcaacgccgctcactataataacactcatgcctgccagcagcagcaactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaagggagttttccggggccctctcagcaagaacgggaacaaaactctggactatgctgagaaggaaaataccatagcaaaagctctggaagatctgaaggcaaatttttactgtgaactctgtgacaagcagtactataagcaccaggagtttgacaatcacattaattcatatgaccatgctcacaagcagaggctcaaggaactgaaacaaagggaatttgctcgaaatgtagcatctaaatccaggaaagatgaaagaaaacaggaaaaggcactccaacgcctgcacaagctggctgagctaagaaaggaaactgtatgtgctcctggaagtggccccatgttcaaatcaacaactgttactgtgagagaaaactgtaatgaaatttcccaacgagttgttgtggattcagttaataaccagcaagatttcaaatatactttgattcatagtgaagagaatactaaagatgctaccactgttgctgaagatccagaaagtgcaaataattatacagcaaaaaataaccaagttggggatcaagcccaggggattcacagacacaaaatcggcttttcttttgcatttccaaagaaagcgtccgtgaagctagagtcctcagctgcagccttctctgaatacagtgatgatgcctcagtgggaaaaggatttagcagaaaaagtagatttgtccccagtgcttgtcatcttcaacaatcttcaccaacagatgtgcttttgagttctgaggagaaaactaactcttttcatccaccagaggcaatgtgcagagacaaagaaactgttcaaactcaagagataaaagaagtctctagtgaaaaagatgcattattattaccttcattttgcaagtttcaacttcagttatcttctgatgcagataattgtcaaaattcagtcccattagcagatcaaataccactagagagtgttgttattaatgaagacatacctgttagtggtaacagttttgagttgttaggaaataaatccacagttcttgacatgtctaatgattgcatatctgtgcaagctaccacagaggaaaatgttaagcataacgaggcatccacaactgaggttgaaaataaaaatggtcccgagacattggccccttcaaatactgaagaggttaacataactatacataagaaaacaaatttctgcaaaagacaatgtgagccatttgtacctgtccttaacaaacacagatctacagttcttcagtggccatcagaaatgctggtttatacaactacgaaaccatcaatttcctatagctgtaatcctctatgttttgacttcaagtctactaaagtaaataataatctagataaaaataagccagacttaaaagatctttgttctcagcagaagcaggaagacatttgcatgggaccactttcagattacaaggatgtatctacagaaggactcactgattatgaaattggaagtagcaaaaataaatgcagccaagtcactcctcttttggctgatgatattctctccagtagttgtgattctggaaaaaatgagaacacaggtcagaggtataaaaacatttcctgtaagatcagagaaacagaaaagtataattttactaaaagtcaaataaaacaggacactctagatgaaaaatacaacaaaataaggttgaaagagacccatgaatactggttccataaaagtagaagaaagaaaaaaagaaaaaagttatgtcagcatcatcatatggagaaaaccaaagaatcagaaactcgctgcaaaatggaagcagagaatagttacactgaaaatgctgggaaatatctattggaaccaatttcagaaaagcagtatttagctgcagagcaattattagactcacatcagttacttgataaaaggcccaaatcagaatccatatccttaagtgacaatgaagaaatgtgtaaaacatggaatactgaatacaacacttatgatactatcagttctaaaaaccactgtaaaaagaacacaatacttttaaatggacaatcaaatgcaacaatgatacattctgggaaacataatttaacatattctagaacttactgttgttggaaaaccaaaatgtcaagctgtagtcaggatcacagaagcttagttcttcaaaatgatatgaaacacatgagtcagaatcaggctgttaaaagaggttacaattctgtcatgaatgaatcagaaagattctatcgaaaacgtagacaacattcacattcttattcttcagatgaaagtttaaatcgacagaatcatttaccagaagaatttttgaggccaccaagtacttcagttgctccctgcaagcctaaaaagaaacggaggcgaaaaagaggcagattccaccccggatttgaaactttagaactcaaagaaaatacagattatcccgtgaaagacaattcttccttaaatcctctggataggttaataagtgaagacaaaaaagagaaaatgaaaccacaagaagttgcaaaaatcgaaaggaactcagaacaaacaaaccaattaagaaacaaactgtctttccaccctaacaatctccttccttctgaaaccaatggtgaaactgagcatttagaaatggagaccacttctggtgaattgtcagatgtttccaatgatcccaccacatctgtctgtgtagctagtgccccaacaaaagaagcaattgacaataccctgcttgaacacaaagaaagaagtgagaatataaatcttaatgaaaagcaaattccttttcaggtgcctaatattgaaaggaactttagacagtcacagcctaaatcctatctttgccattatgaactggctgaggcccttccacaaggaaagatgaatgagacaccaactgagtggctgcgttataattcaggaatccttaacacacaaccaccattaccattcaaagaagcacatgtcagtggtcatacttttgtaacagctgagcaaatcctggctccattagctttaccagagcaagcattattgatcccactagaaaaccatgacaaattcaaaaatgtaccatgtgaggtctaccagcacattctgcagccaaacatgctggccaacaaggttaaatttacctttcctccagctgccctcccaccccctagcacacctctgcagcctttgcctttgcagcagtccttatgttctacctctgtaaccactatccatcacactgttttgcagcagcacgctgcagctgctgcagctgcagctgcagccgcagctgcaggaacctttaaagtgcttcagccacaccaacagtttctttcccaaatcccagctctcaccagaacctcattacctcagctctcagtaggaccagtaggaccgaggctttgtcctgggaaccagccaacttttgttgctcctcctcagatgccaatcattccagcttccgttcttcatcctagccatctggctttcccatctttaccccatgcactctttccttcactgctttccccacaccctactgtcatccctttgcaacctctcttctagtcatcaccataatgggaaaaaaatactcttgtgaaaactattgctatatgcgttaagtgttcatctatgtgggtacatggctatttaactggtggaaataaactggccgatacatggcgtcattggtttgaaatcatttactgtaagtgcaatgatgcaaataaatccctaagtttctgatatataatattattaaagcactgaatagtttgaaaatcaatacaatatatgctatatattaaaatgatgtcttaagagtatgtataatgtacataaaatatatttatagtactctaatttatgttgtaaagtatgctcccttggtttttcttaatctttgtgtatttgcacctatttaatgtttagacaaagctgatggcactatgttttgtatcatgttccttgaaactgtaaattcagtgaaaaatatctcttgcaataaatttttgttaactatttaagtaaa

SEQ ID NO: 35373 - DNA, 610 bp, Homo sapiens
gttgtcaggaggattcgacgttcagtgcccagggatgtggaggtgatggggggccggggaggagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtgggtaaggacaaccatcctgtgaagttgtgaggagcctgttatgggttaaattgtgcccccaaataaaatatgttgaagtcctaata

SEQ ID NO: 35374 - DNA, 7859 bp, Homo sapiens
ggaagcggctgcggttctcgccggttctcagccggggtttgatagttgtcaggaggattcgacgttcagtgcccagggatgtggagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacaagagatgattcattatactctattttagaagaattgtggcaagatgctgaacagataaagagatgtcaggaaaaacacaacaaacttctgagtcgcactactttcctcaataagaaaatattgaatacagagtgggattatgaatataaagactttggaaaatttgttcatccaagcccaaatctcattctttcacagaaaagaccccataaacgtgattcatttgggaagagttttaagcataatttagacttacatattcataataaaagcaatgcagcaaagaacctggataaaactattgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataaggctgacaaaagtcaggtctaactatatattataaaattcatccaagacagatcctatatgaatacattgtataaggaaaagcatcaggctatctcacttgagatggaaaaaaattattcagaagaaactctcttaaaaatgcattgaaggagagagaatttgcacagcctcatgaaatatagtaaaagtcatactgggaaaaatgttgtcagtttggtgtgttaggaaaagccttcctatagaaagtattataagttaaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagttttggggttagtttgttgtacagaaaatgctaagtaatatttgaaagtatatgtttgggggagggggcatagtggaccaaaacgtgacaagtggcattggctttgggtctgagtggcacgtagaaactggaaaaacagtgaggaaaactgtttttcctcaaataacaaaggttggatagttggcaacccatgttatttagtagggaaagatacagaaaaacagtcatcaccatactctgtgggaagatagagaatggaccaaacgaactggtggatctggctaaggagatttgcagcagaatatgggaagtatcagtttgcttcttttagctgcatatgatacgatacagaaagagagaaatgaactaaagaaataactgtttctttggcaagcagaattcagaagaaatatggaaaagccaaggattgctgggttgaaaaataatgctttcacatcactagtctctccagctatctaactattcgcaaggtaaaaaatggcctcagggtaaagatcaaatcatggttgtgtctgtaagactctttattacagtgtgtgaaatagttcagttggtgcttaggagaccatctcagctaaacttaagggcttctaaaaatcttcatgacgttgtcccatagaagcctgacatactactcaaagtggagagagacctatcttaaaaagaattgctgatgtggcatttggggaaaggagtagatccaaaccagattcataggaaactcacaaagtttttaatagagttttactagtaaaactacctccaggttggacttccagggactgaaacagttcaaaatgaaaagtggcctctggattcccctccctaacttctatgaataggatacaagctgagaaagttactcagatgcaaacacggtccatttcttatggaaaatgaagggcatctcagagggaagacccaagaacaatatattaaaatgagctggggagccgttcccagggagaactgtgccctaatcaagaaacgtatctgcccctggagccaagggaaccgacaacatttgctctgtgggatttcagaatcgttatggaacagtgactgatatgtgcctcatggtcctcctctttttgaatgggagtgtctattacagttatcctgtacctatcccaccattgtatatattgggtgtatgttggggggcatgtaacttgtcatttagctcacaggtatctggatcaagaaactgaaaaactgtacccaaggaacctcagccacacctgaacctgatacagaagacttgagattctggattggagcttgatgccacaattttggatgagaaatttggaggtcctggaataggggtgaacacattttgcatggggtggtaatgtgaatactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactttcatgttttaatctctgctctgtgctcataatcatatatagacat

SEQ ID NO: 35375 - DNA, 492 bp, Homo sapiens
gtgcccagggatgtggagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagggatttccacatatttcgtcacatccacagtaaa

SEQ ID NO: 35376 - DNA, 7933 bp, Homo sapiens
ggaagcggctgcggttctcgccggttctcagccggggtttgatagttgtcaggaggattcgacgttcagtgcccagggatgtggagagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacaagagatgattcattatactctattttagaagaattgtggcaagatgctgaacagataaagagatgtcaggaaaaacacaacaaacttctgagtcgcactactttcctcaataagaaaatattgaatacagagtgggattatgaatataaagactttggaaaatttgttcatccaagcccaaatctcattctttcacagaaaagaccccataaacgtgattcatttgggaagagttttaagcataatttagacttacatattcataataaaagcaatgcagcaaagaacctggataaaactattgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataaggctgacaaaagtcaggtctaactatatattataaaattcatccaagacagatcctatatgaatacattgtataaggaaaagcatcaggctatctcacttgagatggaaaaaaattattcagaagaaactctcttaaaaatgcattgaaggagagagaatttgcacagcctcatgaaatatagtaaaagtcatactgggaaaaatgttgtcagtttggtgtgttaggaaaagccttcctatagaaagtattataagttaaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagttttggggttagtttgttgtacagaaaatgctaagtaatatttgaaagtatatgtttgggggagggggcatagtggaccaaaacgtgacaagtggcattggctttgggtctgagtggcacgtagaaactggaaaaacagtgaggaaaactgtttttcctcaaataacaaaggttggatagttggcaacccatgttatttagtagggaaagatacagaaaaacagtcatcaccatactctgtgggaagatagagaatggaccaaacgaactggtggatctggctaaggagatttgcagcagaatatgggaagtatcagtttgcttcttttagctgcatatgatacgatacagaaagagagaaatgaactaaagaaataactgtttctttggcaagcagaattcagaagaaatatggaaaagccaaggattgctgggttgaaaaataatgctttcacatcactagtctctccagctatctaactattcgcaaggtaaaaaatggcctcagggtaaagatcaaatcatggttgtgtctgtaagactctttattacagtgtgtgaaatagttcagttggtgcttaggagaccatctcagctaaacttaagggcttctaaaaatcttcatgacgttgtcccatagaagcctgacatactactcaaagtggagagagacctatcttaaaaagaattgctgatgtggcatttggggaaaggagtagatccaaaccagattcataggaaactcacaaagtttttaatagagttttactagtaaaactacctccaggttggacttccagggactgaaacagttcaaaatgaaaagtggcctctggattcccctccctaacttctatgaataggatacaagctgagaaagttactcagatgcaaacacggtccatttcttatggaaaatgaagggcatctcagagggaagacccaagaacaatatattaaaatgagctggggagccgttcccagggagaactgtgccctaatcaagaaacgtatctgcccctggagccaagggaaccgacaacatttgctctgtgggatttcagaatcgttatggaacagtgactgatatgtgcctcatggtcctcctctttttgaatgggagtgtctattacagttatcctgtacctatcccaccattgtatatattgggtgtatgttggggggcatgtaacttgtcatttagctcacaggtatctggatcaagaaactgaaaaactgtacccaaggaacctcagccacacctgaacctgatacagaagacttgagattctggattggagcttgatgccacaattttggatgagaaatttggaggtcctggaataggggtgaacacattttgcatggggtggtaatgtgaatactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactt

SEQ ID NO: 35377 - DNA, 3573 bp, Homo sapiens
ctgcctctgatcatatggacactgtctttccagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagatgggaaatttggaattaagccttcccagaggagaatttctgggaaatctacatttcatagtgaaatggagggtgaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaac

SEQ ID NO: 35378 - DNA, 2599 bp, Homo sapiens
agacctggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtagtgaatctgg

SEQ ID NO: 35379 - DNA, 1467 bp, Homo sapiens
atgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaa

SEQ ID NO: 35380 - DNA, 2806 bp, Homo sapiens
gcaaatctggaagcggatcgcgtggagtgacggtcacaccgcggcgaattaatttccaaagactcatgttacatgagaaagccaccaagaagaccaaagaaaaggagacaaggatggctcttcctcagggatgcttgactttcagggatgtggctatagaattctctttggaggagtggaaatgcctgaaccctgcacagagggctttatacagggccgtgatgttggagaactacaggaacctggagtctgtgggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 35381 - DNA, 2824 bp, Homo sapiens
agacctggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtagtgaatctgg

SEQ ID NO: 35382 - DNA, 3125 bp, Homo sapiens
tttgtatttctgaccacctcaatatccacagtactcagtccccatgctactctcaccatgtaaggaaagacacttgcttatctgtaggacggctttctcagaacacagcctaaaccgatgtctgctctgtacgatggtggacataccgctgtctaggaaggattaccaagtgacatggtcagcaacacaaccccgttcttgtagctcccttgaaatgattcctttctatgcatctatttgccatgtcgtgtcgtgttgtgcaggtttgtcgtgtgggtatatgtgtgccgtggtggtttgctgcacccatcaacccatcatctaggttttaagccctgcatgcattaggtatctttcccaatgttctccctccccttgccccctaccccctgataggccctgctctatgttgcttccctccctgtgaccatgtgttctaatcgttcaactcccacttatgagtgagaacatgcggtgtttggttttctgttcctgtgttagtttgctgagaacgatggcttccagctccatccatgtccctacaaaggacatgatctcattcttttttttctttttccgagatggagtttttgctcttgttgcccaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 35383 - DNA, 2940 bp, Homo sapiens
agacctggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcagggtctattgacattcagggatgtggccatagaattctctcaggaggagtggaaatgcctggaccctgctcagaggactctatacagagatgtgatgttggagaattataggaacctggtctccctgggacggctttctcagaacacagcctaaaccgatgtctgctctgtacgatggtggacataccgctgtctaggaaggattaccaagtgacatgatggagtttttgctcttgttgcccaggctggagtgcagtggcacaatctcggctcaccaccacctccgcctcccgggttcaagcgattctcccgcctcagcctcagaagttgctggaattacaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtagtgaatctgg

SEQ ID NO: 35384 - DNA, 2633 bp, Homo sapiens
ggcttctgtactgcgcgcgcacatgcgcgcaaacccggaagcggattatgtggagtgaaagttacaccgtggcggaatggggtgtattgattctgagcaataaacaacatatttttaacattcaggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgt

SEQ ID NO: 35385 - DNA, 9404 bp, Homo sapiens
atggaggttccagaacccacctgccctgcccctcctgcgagggaccagccagctcccactcctggccctccaggggccccaggtggccaggcctcacctcacctgaccctgggccctgtccttctgccgccagagcagggcctggccccccccactgtgttcctgaaggccctgcccatcccactgtaccacacggtgcctcccgggggcctccagccccgcgccccgctagtgacgggcagcctagatgggggcaacgtgcccttcatactcagccctgtgctgcagcctgaagggcctggccccacccaggtggggaagccggcggcccctacgctgacggtgaacatcgtgggcactctgcctgtcctgtcgccgggcctgggccccacgctgggcagcccaggcaaggtgcggaatgcgggcaagtacctgtgtccgcactgtggtcgcgactgcctgaagcccagtgttctagagaagcacatccggtcccacacgggtgagaggcccttcccgtgtgccacctgcggcatcgcctttaagacccagagcaatctctacaagcacaggcggacgcagacgcacctcaacaactcccggctgtcctcagagtccgagggcgccgggggcggcctcctggaggaaggggacaaggccggagagccccccagaccagagggcaggggcgagagcaggtgccaggggatgcacgaaggcgcctcggagagacccctttctccgggtgcccacgtgcccctacttgccaagaacctggatgtgaggaccgaagctgctccctgtccagggtccgcatttgccgacagagaggctccttgggactctgcccccatggcgtcacctgggctcccagcggccagcacacaaccctggcgtaagttgccagagcagaagtcgccgaccgccgggaagccgtgcgccctgcagcggcagcaggcgacggcagcggagaagccctgggatgccaaggcccccgagggccggctgcggaagtgtgagagcaccgactcggggtacctgtcgcgctccgacagcgcggagcagccgcatgcgccctgcagccccctgcacagcctttcggagcacagcgccgagtccgagggggagggcggcccgggcccggggccaggggtcgcaggggccgagcccggggcgcgagaagccggcctggagctggagaagaagcggctggaggagcgcatcgcccagctcatctcccacaaccaggcggtggtggacgatgcccagctggacaacgtgcggccccggaagaccgggctgtccaaacagggcagcatcgacctgcccacgccctacacctacaaggactccttccactttgacatccgcgcgctggagccaggccgtaggagggccccgggccccgtgcgctccacctggacgcccccagacaagtctcggcccctcttcttccactccgtccccactcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcggccagagaaggctgaagatgttctcccaggagaagtggcaggtgtacggggatgagacgttcaaaaggatctaccagaaaatgaaagccagtccccatggaggcaagaaagccagggaggtgggaatgggcagtggggcagaactgggctttcctctgcagaaagaggcagcagggagctcaggcacagtccccacccaagacaggaggacccctgtccatgaggacatatccgcaggggcaacgccagagccttggggaaatccaccagccctggaggcctccttggtgactgaacccactaagcatggggagacggtggccaggagaggagacagtgaccgacccagggtggaagaggctgtgtcatcccctgcactgggtggcagagacagtccctgttcaggcagtaggagccccctggtctctccaaatgggaggctggaactggggtggcagatgcccccagcacctggccccctcaaagggggtgatgtagaggctcccaggccagtttggccggaccccaagctggaaggaggtgcccgaggtgtgggggatgttcaggagacctgcctgtgggcccagactgtcctgagatggcccagcaggggctcaggggaggacaagctcccctcagagaggaagaagctgaaagtggaggacctgcacagctggaagcaaccagagcctgtgagcgcagagaccccaggtgggcccacgcagcctgcctctttgtcatcccagaagcaggatgccgatcccggggaggtgccagggggctcaaaggagagtgccaggcaggtgggcgagcctctggagtcctctggagcctccttggctgctgcttctgttgccctgaagagggtggggccaagggacaaggctaccccactgcatcctgcagccccagcccccgcagagcacccctcgctggccaccccacctcaggctcctagagtgctctctgccctggcagataatgccttttcccccaagtacctcctcaggttacctcaggcagagacccccttaccactgcccattccctggggaccaaggcacagccaggactctctctgcagcagtgggtggcctgaagaacgggcatcatttgttgggtcaggactggggacccctctttctcccagcccagcctcaggcccctccccaggtgaggcggacagcatcctggaggaccccagctgttccaggccacaggatgggagaaaaggggcacagttggggggggacaagggggacaggatggccactagcaggccagcagccagggagttgcccatctcagcaccaggggctcccagggaggctacctcctccccgcccactccaacgtgtgaggcacacttagttcaggacatggagggtgacagccaccgtatccatcgcctctgcatgggcagcactttggcaagggccaggctctctggggatgtcctgaatccctgggtacccaactgggagctgggggagcctcctgggaatgccccagaagatccttcttcagggcccctggtgggccccgacccgtgttcccccctccagcctggctccttcctcactgccctcactcggcctcagggtgtgcccccaggctggccagagctggccttgtcttcccactcagggacgtcccggagccacagcacccgcagtccccacagcacccaaaacccctttccctcactgaaggctgagccgcggctcacgtggtgttgcctgagccgcagtgtccctctgcccgcggagcagaaggcaaaggcggcatctgtgtacttggcggtgcactttcctggtagcagcctccgagatgagggtcccaatggccctcctgggagcaatggaggatggacctggacaagccctggagaaggagggccggcgcagatgtccaagttctcctacccaacagtcccaggggtgatgccccagcaccaggtgtctgagccagaatggaagaaaggcctgccttggagggcaaagatgtctcgtgggaacagcaagcagagaaaactgaagatcaaccctaaaaggtacaaagggaatttcttgcagagctgtgttcagctgagagccagtagacttcgcacaccaacctgggtgcgaagaagaagccgccaccctcccgcacttgagggactgaagccatgcaggacccctgggcagacctcttcagaaatagcaggtctgaatctgcaagaggagccatcttgtgccacctcagaatcacctccttgttgtgggaaggaagagaagaaggaaggtgactgcagacaaaccttaggaaccctctctcttggtacaagttcaagaattgtcagggaaatggacaaacgaactgtgaaggatatttctccatctgctggtgagcatggtgactgtactactcacagcactgctgccacatcaggattatctctgcaatctgacacctgcctggcagtggttaatgacgtgcctctaccccctggcaaaggtcttgaccttgggttgctggagactcagctgctggcctcccaggattcagtctcaacagatcccaaaccatacatcttctcagatgctcaaaggccttcttcctttgggtccaaaggaacttttccccaccatgacattgctacctctgtggctgccgtttgtatttctctgccagtgagaacagatcacatagcccaggaaattcacagtgctgaatcacgagaccacagccagactgcagggaggactctgacatcaagctccccagacagcaaagtcacagaagagggcagagcacagaccctcttgccagggagaccttcatctggacaaagaatttcagattcggttccactggagtcaactgaaaaaactcatcttgaaataccagcttcaggaccaagttcagctagttcacaccacaaggaagggagacacaagacgttttttccttccagaggccagtatgggtgtggggaaatgactgtcccctgcccctctttaggaagtgacggtaggaaacgtcaggtatctggattaatcactcggaaagattctgtggttccttctaagccagagcagcccatagaaattcctgaagccccttctaaatccctcaagaagaggagtctggaaggaatgagaaagcaaactcgagtagagttcagtgacaccagcagcgacgatgaagaccgattagttatagaaatatgaagcttccagagaaacatggtgtctggtcaaaaagactgttgacgcttcacaagtaaatgttgtcaggctggcggaagaactaaactctatctgtgaaacacctacagattaggaaagccattttgagttatttacaagccaactccaaccaacttctgacccccaactcagccgcagcgttccccagctccccttgggagtgctctgctcatcttcaaatggtgccaggcagggcagacatggcaaggaagcaaactctgcaaatggtcaacgtgcacagtgactgggccttgactcccagcctcgtcttctgcacctgtcccccactgcctctctgcaatcaaatggcactaaccaagaaagccaccatcaacacatttctccacaagtggaccccacacagtcgaggcaactggctttctccattagtaaactgaggatttgcttccaaggtggagagcacacttgggataattggagtagcttgacaaagagacgggggtgtgaactgggcacaaagatacttctgttcattttggagacaaaattcagatacattaaaaaactgaagcttgttcagagtaattcacgtccttggtggagttgtaaatacacttcaaaatgcctatgatccggtgacatgctgattacttttaaatgttgcacaaatggtcaatgcttatttatggtcagatgatgcaagcacatgctcttgtgcctggtgcgtttgctgtggagatctctgagactgtcggtttttctagttcttgcaaaggaacggtgttaaaagttaatagaactgtctctctgtaatgagtcattttttgagagggaaaaattcacttattttcctctgattcttcttgtcatattgtgctctgagcaatttcaattagagggttacattttagtaatctgtacagcttcaactgatgcctgctcgtcgtgacgggagccttttagatttccttcagaagcttcaaggatacaaaactaattggagttttgacgctgttttacatctcggtaattttattttcggggcttagtgttactttgctgtcaaattaaatcagcctctgtattgtgcacgtcagaactgcacagagaaaattccccagtattccaagccggtgcgcccctgtgcagaagaaaacagatctacgtcagccagcccggggggcaaagcctcagttccactgccttcctctccctctccttccacgggagaggagaaacttaaagaggtttacattgctgcatttcaataaaattttatacttgcttttggtatgattttgtacaatttgaaatttgtagctgagctcttttggtgtaactttgatgtaatgatgttcatatgacatcttgtacttcagagacacagcagcaatgcagagcatctcacacatgtgaatacacttcagtcagtctgtgcctgtgactaagtatggtcaaatttcaagtatcttcatgtgaattttccaattttggtgtttttcatagaaaacttcaatgccagaccagcttccctggttacttagcatatatttgtgaccatttcatatgcactcataaatatccaaggatttcaggcccagccaagaaaaacataagaagggaggtaaaaaggatgttggacattgacttagtgtactttttaaacccaacaaaagcgatgtggtgattatctcccttttcgaaggattcatgccactgtaatgagagaggcagtgtaggcaaatggtctgagccttggatggagattgaagtcctgactttagctgggaaatcttggttaagagtctttctgtaccttagtttccctaagtgagaataagagagttggacaagacgaatgtatctccaggttccaatttttctgagaatggttgatagagaagctgctctctccttaaaatgcatggactcaatggcttgaagatattccccatggggaaccattgccacggaggccttgcatgcaagaagtttgggtggggacagtgaggaactgaaacacaagcaccttccaccaattattgctgtgaagaacctgagcctgaagaagctccatctaattttttccccagagttccagattttagggtgcaatcatccagcctatacatgtggctcatagttcaaaaaattaaaagcaaaaccagaactctccagtaggaatggagaaaacctatctgtaggctgaactggctcctttgtcttaggaggcactggtcaggggaaaaaagctgtcttccagacccctcctttctgggtggctactgtggaatcaacggggtcactggctgtaaatcagtaagtcatagctccaaacagcaccaacttcaggatgatggtggaagctctgtccctataggagccaccgttgccagctgtcacatcccaacctaggtcaaatatggcggaatattgatttcgtctctaactccctgtatctcttacaaaggtaaagcaggtagcgaagccaccttgcttccctggtctttgcctagtggctggcaatgtttacaagtgtaccttactttatatcaacatgaatttgtgaaaaagctgtatgtcaatggattttttaaaaattaaaaatgtattttgaatgaccctaagggagctggctctttaaaagcatcctaaggtaaagattttttttaaatgaagaatctttttataaagcaatgaacaatctctgattttataaatcttaattttcctatgggttttcttaaagtgaaatacaattataagaatacattttaagggtaacattaacaacctagaacccagtttgggttactaaaaataaaatgtcagtattatcaattgataactaccacagttttatactctgcaagtgtgtactgcatgatggttaaggaaaaacaaatttattttagaacaaagcaaaccagagtttaaagatcagggatttccttctttccccagtgctaattttcccagtgttaattttattatatctttaggtaagggtcttaaccaactgatgcctcagtttcttccacagagaatagttagagggatgctgtcatgaactaagggaagggcactgaatttttttttgccaatatcaaaagtgacatttccccatgatgttcaagactcaccaggtttctctctccacctgtacctacacccagctagatcttgtcgttaaagatgtatggagggaagaggtttcaatccttccctccttggcaacctacattgttaagtgactcaaagtcatgtgatttttggtggacaactggaatcctccttcttgtaaaacacattgaaaaacagctcatctctcctgttaggcttaacccttgagatttgagacaaagctaataatcccctttggttcacatctcacagtaaccaggagaacctatggttcatttgccaagtgattaaaaaaaaagatggaggagggtgtctctgaattttaatggaaacactgccaatagcatggtgggtaacctagggcaagacagactttttcttcctgaaatcactcttctaaagctgagaccggaagaggaaccttgcagaagtgcactgtgaccacagttcttggcatgaaagataaacaatttgcagtctcatgccaaaaagtatttccttgcatttacattcattacttagaatgatcacattattcatttttttccccagcacagaaatttgcattttgcacagaatttgcctggtgcagcagatctttatagttatggaaactgtcatcattatcggaatgtgctgctgctcaactccccagacataatttaatatggtgaggagaatatgacctgcctggctctatgggtgatcatatttctactgctgcagcaagctgggcttgtgtatttttcctcacttcagttgttcttcccatagttcatgtagggaggcactttggcttttgaaacactacatttctcaatatttaagcacaatttattgtccttatttttcagaacccattaaatataagggtcagaacctagaaaatcttatgtgctggatttctaccctgtatgattcttttcatccatgctttgcacttacgtaggaatatacataatttggtctgaagaagtataggaacagttgagcacattacttcaccactggaagaataggaaccagggaaaaacatcagcctctgccacttggagcactagaggatgacggaatgtcttgtatatgcggtcaactgttcaggatttactactcaattggttgttcacaatcagggaaatgattggcttcttggttgtttgttgaactttctttctttatatggttaaattattttgttttgataaaaataaaacttaaaatgcaaa

SEQ ID NO: 35386 - DNA, 1529 bp, Homo sapiens
gctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagaatcttactctgtcacccagtctggaatgcagtagcaagattttggcccactgcagcctcaaccttctggggtcaagtgattgttccacctcagcctcccgagtagcttggactacagacatgcagtactatgcctggctaattttttgattatttgtagagacagagtctcactttgttgcccagtctagtctcaaacttctggctccaaatgatcctcctaccttggtctcccaaagtgttgggattataggtatgagcctgttcacccagccagtattcttaaatttaataagatttgttatgtgtcctaacagaatacacaaggtgcaaataagaatgttgtgtattctcttgcttttgactgaaaagttttgtacatgtctgttaatcctagttggtctgtgatgtggtttagatgttcgtgttcttcaaatcttatgctgcaatgtaatcctcactgttggatgtggaacctggtgggagatgtttagatcatggggcaaatttctcatgaatggctttgtactatcctcttggtaatcaaaaagtttacactctgttaattcagatgagagctgcctcattaaaagaacctggccccttcacctcacatttggttctgtcttttactatgtgatatgtccagttactgttggccttccaccattgtggaagcttactgaaaccttccaccagaggcagatgccggcacacacttcttgtacagtctgcccaacgatgaaccaaacaagcctttttatttataaattatccactctcaggtattcctctatgtgcaaaataatatattctgtaacgttgtctaagttttctgttttcttattgatcttttgtctgaattttctatttattattaaaaatggggtcttgatgtctacaattattatgttgctatgtatttcttgtttcacttttgtcaatatttgctttacgtattttggagccctaatgttgtatatacatatacacataaataaataggcataatagttttagattcctggtaaattgatccattttactattgtataatatcagtctttgtctcatgctagtacttgacttaaagcatataatgtctaatataattatgagtgtcttactcaattgtggttatatttgcatgtaataaaaagtttttccattctgtt

SEQ ID NO: 35387 - DNA, 2331 bp, Homo sapiens
ctttgtctctcgctgcagcctgagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaa

SEQ ID NO: 35388 - DNA, 1814 bp, Homo sapiens
gctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctggttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatga

SEQ ID NO: 35389 - DNA, 2656 bp, Homo sapiens
gctgagaaaggtaaaaacacctccagataaggaataggaacaggctatgacctaatgcttgcttggaccagtataagcatgccagggcaaatatttaggctaaaatgtgggagctaagaacacaaagtacattgatttctttatcacggctagcagatatctaagaatgtcagcacaggtgtttgaatacattttgcttctaagagaagttactatttattcctaattacacgaggaggaaagtccctttgaaaaggaacctctatttcacattttacgatgagcacaatatagttttgcattggtgtatatgaatttgaatgagcaaacagctcttcaagtttttggggtttttttgtttgttttgttttttgggtttttgttttttgtttttgagacggagtctcactctgtcatcaggctggagtgcagtggcacgatctcggctcactgcaacctccgcctcctgcgttcaagtattcccctgcctcagcctcccaagtagctgtgactaaagccgtgcaccacaacgtctggccaattttttgtattttagtagagacgaagtttcaccatattggccaggcgagtctcaaactcctgacctcgtgatccacccacctcagcctcccaaagtgcttggattatagacatgagcctcagcgcccagccctcttcaagtttttataaaccagtttcagaagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatgg

SEQ ID NO: 35390 - DNA, 2310 bp, Homo sapiens
ggtgctccaaatctggtcttagctgcttcgtgtcttcttctccagcctctgtggccctgtgacctgcaggtattgggagatccacagctgagggacccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaacccttgctacacataagaaaattcatactggagagataacctgcaaatgtgaagaatgtggcaaagccttcaacaggtcctcacaccttacttcacataagagaattcatactggagagaaacggtacaaatgtgaagattgtggcaaagaattaaagtattcctctacccttactgcacataagagaattcatactggagagaaacggtacaaatgtgaagattgtggcaaagaattaaagtattcctctacccttactgcacataagagaattcatactggagagaaaccctacaagtgtgataaatgtggcagagcatttatttcatcctcgatcctttatgtacataagataagtcatactgaagagaaaccctacaaatgtgaagaatgtggcaaagccttcaagctctcctcaatccttagtacacataagagaatccatactggagagaaaccctacaaatgtgaagaatgtggcaaagccttcaggcgctccttagtccttcgtacacataagagaattcatactggagagaaaccctacaagtgtgataaatgtggcaaagcatttatttcatcctcactcctttataaacataagataagtcatagtgaaaagaaaccctacaaatgtgaagaatgtggcaaagccttcaagcgctcctcaacacttactatacataagataagtcatactgaagagaaaccctacaaatgtcaagaatgtgacaaagtcttcaaacgctcctcagcccttagcacacataagataattcatagtggagagaaaccctacaaatgtgaagaatgtggcaaagccttcaagcgctcctcaaaccttactacacataagataagtcatactgaagagaaactctacaaatgtcaagaatgtgacaaagccttcaagtactcctcagcccttagcacacataagataattcacagtggagagaatccctacaaatgtgaagaatgtggcaaagccttcaagcgctcctcagtccttagtaaacataagataattcatactggagcgaaaccctacaaatgtgaagaatgtggcaaagcctttaagcgctcctcacagcttactagtcataagataagtcatactggagagaaaccctacaaatgtgaagaatgtggcaaagcttttaacttgtcctcagaccttaatacacataagaggattcatattggacagaaagcctacatagtgaagaacatggcaaatctttgaaatattcctcaacccttaataaacataagataattcatactggagagaaaccgtataaatgtgatgactgttggaaagcctttgaccacccctctactcttactaaatatgagaatttatatgaaacataactcctacaaaaataaagaatgtgacaaatcattttaaggaagttctcaacccttactacacataattcatactggacggaaactctacaggtgtgaaaaatgcagcaaagcctataacaagttctcaattctttttttttttttttaagaaggagtttcatgcttctcacccagcctggagtgcaatggcacgatctctgctcactgcaacctcttcctcctggttcaagccattaacctgcttcagcctccaccaccatg

SEQ ID NO: 35391 - DNA, 2843 bp, Homo sapiens
gaataatattcttgcaaaaaagaaaccctataagtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagattttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaagcaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagttaagtctaattgcccattgccataaattttgccttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcagcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttg

SEQ ID NO: 35392 - DNA, 4384 bp, Homo sapiens
ctcctgccccggagccgggccctggcgaggcaggaatggccccgaggcctccgaccgccgcgccccaggaatcagtgacattcaaagatgtgtctgtggacttcacccaggaagaatggtaccatgtcgaccctgctcagaggagcttatacagggatgtgatgctggagaactatagccacctggtttctcttggatatcaagtttccaagccagaggtgatcttcaaattggagcaaggagaagagccatggatatcagagggagaaatccaacgacctttctatccagactggaagaccaggcctgaagtcaaatcatcacatttgcagcaggatgtatcagaagtatcccactgcacacatgatctcttacatgctacattagaagactcctgggatgttagcagccagttagacaggcaacaggaaaactggaagagacatctgggatcagaggcatccacccagaagaaaataattacaccacaagaaaattttgagcaaaataaatttggtgaaaattctagattgaacaccaatttggttacacaactgaacattcctgcaagaataaggcctagtgaatgtgagacccttggaagcaatttgggacataatgcagacttacttaatgagaataatattcttgcaaaaaagaaaccctataagtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagattttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaagcaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagttaagtctaattgcccattgccataaattttgccttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcagcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaatggga

SEQ ID NO: 35393 - DNA, 5393 bp, Homo sapiens
ctcgctgccgccggagtttccaggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaactaatgctcacaccttaatgcataggaaagcatttatgcttgagaaaaagtgaacaaatatagacaaaaagccattaatacctgctcacatcgtactcaaattcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaaccaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatcc

SEQ ID NO: 35394 - DNA, 3572 bp, Homo sapiens
aggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaa

SEQ ID NO: 35395 - DNA, 3210 bp, Homo sapiens
aatcaggcacgcaactggagcggacagcacagcttccgggatttggcggggcctttgtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttttt

SEQ ID NO: 35396 - DNA, 3017 bp, Homo sapiens
gtctctcgctgcagccggcgctccacgtctagtcttcactgctctgcgtcctgtgctgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcctggacactgcgcagcggaatttatatagagatgtgatgttagagaactacagaaacctggtcttccttgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaacattt

SEQ ID NO: 35397 - DNA, 2957 bp, Homo sapiens
gtctagtcttcactgctctgcgtcctgtgctgataaaggctcgccgctgtgaccctgttacctgcaagaacttggaggttcacagctaagacgccaggaccccctggaagcctagaaatggtattgctgtctctaagccagacctgatcacctggctggagcaaggaaaagagccctggaatctgaagagacatgagatggtagacaaaaccccagttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcatactagagagtattcttacaaatgtgaagaatgtggtaaagcctttaactggtcctcaacccttactaaacataagataattcatactggagaaaaaccctacaaatgtgaagaatgtggcaaagcttttaaccggtcctcaaatcttactaaacataaaataattcatactggagagaaaccctacaaatgtgaagaatgtggcaaagcttttaaccggtcctcaacccttactaaacataaaagaattcatacagaagagaaaccctacaaatgtgaagaatgtggcaaggcctttaaccagttctcgattcttaataaacataagagaattcatatggaagataaaccctacaaatgtgaagaatgtggcaaagcctttagagtattctcaattcttaaaaaacataagataatccatactggggaaaaaccatacaaatgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagagaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgaggtacatgttcagactaacattcttttgcagtatagtgagaaaaaaacattttaaaattaattatcattttgttgattgtgcttttatgtaataaaatgcagtactttaaaaca

SEQ ID NO: 35398 - DNA, 2794 bp, Homo sapiens
gaacagggcggcttctggtttggcgggtcctttgtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagttatatgttctcattttgcccaagatctttggccagagcagaacataaaagattctttccaaaaagtgatactgagaagatatgaaaaacgtggacatggaaatttacagttaataaaaaggtgtgaaagtgtagatgagtgtaaggtgcacacaggaggttataatggacttaaccagtgtagtacaactacccagagcaaagtatttcaatgtgataaatatgggaaagtctttcataaattttcaaattcaaatagacataatataagacatactgaaaaaaaacctttcaaatgcatagaatgtggcaaagcttttaaccagttctcaacccttataacacataagaaaattcatactggagagaaaccctacatttgtgaagaatgtggcaaagcctttaagtactcctctgcccttaatacacataagagaattcatactggagagaaaccatacaagtgtgataaatgtgacaaagcctttattgcatcctcaacccttagtaaacatgagatcattcatactggaaagaaaccctacaagtgtgaagaatgtggcaaagcttttaaccaatcctcgacacttactaaacataagaaaattcatactggagagaaaccctacaaatgtgaagaatgtggcaaagcttttaaccaatcctcaacacttactaaacataagaaaattcatactggagagaagccctacgtttgtgaagaatgtggcaaagcctttaagtactcccgtatccttactacacataagagaattcatactggagagaaaccatacaagtgtaataaatgtggcaaagcctttattgcatcctcaacccttagtagacatgagttcattcatatgggaaagaaacattacaaatgtgaagaatgtggcaaagccttcatttggtcctcagtcctaactagacataagagagttcatactggagagaagccctacaaatgtgaagaatgtggcaaagcctttaagtactcctctacccttagttcacataagagaagtcatactggagagaaaccctacaaatgtgaagaatgtggcaaagcctttgttgcatcctcaacccttagtaaacatgagatcattcatactggaaagaaaccctacaagtgtgaagaatgtggcaaagcttttaaccagtcctcatcccttactaaacataagaaaattcatactggagagaaaccctacaaatgtgaagaatgtggcaaagcttttaaccagtcctcttcccttactaaacataagaaaattcatactggagagaaaccctacaaatgtgaagaatgtggcaaagcttttaaccagtcctcaacccttattaaacataagaaaattcatactagagagaaaccctacaaatgtgaagaatgtggcaaagcttttcacctatccacacaccttactacacataagatacttcatactggagagaaaccttatagatgtagagaatgtggcaaagcttttaaccattctgcaaccctttcttcacataagaaaatccattctggagagaaaccatacgagtgtgataaatgtggcaaagcctttatttcaccctcaagccttagtagacatgagataattcatactggggagaaaccctagaagtgtgaagaatgtggcaaagccttcaagtggtcctcacaccttactatacactgagagttctgaacttactctgtaaccatcccaaactcctcccaggcacagtctggcagaggtcctgccatttcggagacctggaggaagtggcccatttacagccatgtaggcaggcctgcagaccttggcctttactacggtacctgaagtggttcaatgactcagtttcagttacctgagccacagcttaaggtcagttctgcctatatagaaacccacacagttaacctgaggaaatgctctctggtactcactgaaagccacactcatccacatcctgatacaaggcccaccatatgcagacctgactgccaaaacatgccctagtgtctgccgtacagagtgaagtcctgaaggatatttagtctgtccaaaactaaaatgaagatttcaactccccaaccccctctaacaagccagctaaaggtggactatagtgcagacccagcaaccttgtgaccaggctaaaacccctcatcactacaaattcagagggcatctcatcaccctaagggcccaacgaaagatctttaccttctaacatcagtttatgaaaacttgaaaaggtgtttgctccatcaaattcagacaccagtacaaaactatattatgcccattgtctggttctattttaatgtagcactggaagtgtgtggcagaagaattagtcaaagaaataaaaatagccattgaaattg

SEQ ID NO: 35399 - DNA, 1955 bp, Homo sapiens
gaacagggcggcttctggtttggcgggtcctttgtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagttatatgttctcattttgcccaagatctttggccagagcagaacataaaagattctttccaaaaagtgatactgagaagatatgaaaaacgtggacatggaaatttacagttaataaaaaggtgtgaaagtgtagatgagtgtaaggtgcacacaggaggttataatggacttaaccagtgtagtacaactacccagagcaaagtatttcaatgtgataaatatgggaaagtctttcataaattttcaaattcaaatagacataatataagacatactgaaaaaaaacctttcaaatgcatagaatgtggcaaagcttttaaccagttctcaacccttataacacataagaaaattcatactggagagaaaccctacatttgtgaagaatgtggcaaagcctttaagtactcctctgcccttaatacacataagagaattcatactggagagaaaccatacaagtgtgataaatgtgacaaagcctttattgcatcctcaacccttagtaaacatgagatcattcatactggaaagaaaccctacaagtgtgaagaatgtggcaaagcttttaaccaatcctcgacacttactaaacataagaaaattcatactggagagaaaccctacaaatgtgaagaatgtggcaaagcttttaaccaatcctcaacacttactaaacataagaaaattcatactggagagaagccctacgtttgtgaagaatgtggcaaagcctttaagtactcccgtatccttactacacataagagaattcatactggagagaaaccatacaagtgtaataaatgtggcaaagcctttattgcatcctcaacccttagtagacatgagttcattcatatgggaaagaaacattacaaatgtgaagaatgtggcaaagccttcatttggtcctcagtcctaactagacataagagagttcatactggagagaagccctacaaatgtgaagaatgtggcaaagcctttgttgcatcctcaacccttagtaaacatgagatcattcatactggaaagaaaccctacaagtgtgaagaatgtggcaaagcttttaaccagtcctcatcccttactaaacataagaaaattcatactggagagaaaccctacaaatgtgaagaatgtggcaaagcttttaaccagtcctcttcccttactaaacataagaaaattcatactggagagaaaccctacaaatgtgaagaatgtggcaaagcttttaaccagtcctcaacccttattaaacataagaaaattcatactagagagaaaccctacaaatgtgaagaatgtggcaaagcttttcacctatccacacaccttactacacataagatacttcatactggagagaaaccttatagatgtagagaatgtggcaaagcttttaaccattctgcaaccctttcttcacataagaaaatccattctggagagaaaccatacgagtgtgataaatgtggcaaagcctttatttcaccctcaagccttagtagacatgagataattcatactggggagaaaccctag

SEQ ID NO: 35400 - DNA, 530 bp, Homo sapiens
gtctctcggtgcagccggagctccaggtctcctcttcactactctgtgtcctgtgctcctacaggcccagcctctgtggccctgtgacctgcaggtattgggagatccacagctaagacaccaggacccctggaagcctagaaatgggaccattgcaatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagttatatgttctcattttgcccaagatctttggccagagcagaacataaaagattctttccaaaaagtgatactgagaagatatgaaaaacgtggacatggaaatttacagttaataaaaaggtgtgaaagtactccatctgaaaaagaaaaaaaaaagaaa

SEQ ID NO: 35401 - DNA, 2260 bp, Homo sapiens
gtctttgtctctcgctgcagccggagttcctggtctcgtcttcgcccttctgtgtcctctgctcgtagaggcccagcctctgtggccctgtgacctgcaggtattgggaatccacagctaagatgccaggaccccttggaagcctagaaatgggagtgttgacatttagggatgtggccttagaattctctctggaggagtggcaatgcctggacaccgcacagcagaatttatataggaatgtgatgttagagaactacagaaacctggtctttgtgggtattgctgcctctaagccagacctgatcacctgtctggagcaaggaaaagaaccttggaatgtgaagagacatgagatggtaactgaacccccagttgtatattcttattttgcccaagacctttggccaaagcagggcaaaaaaaattatttccaaaaagtgatactgagaacatataaaaaatgtggacgtgaaaatttacagttaagaaaatactgtaaaagcatggatgagtgtaaggtgcacaaagaatgttacaatggacttaaccagtgtttgacaactacccagaacaaaatatttcaatatgacaaatatgtgaaagtctttcataaattttcaaattcaaacagacataagataggacatactggaaagaaatctttcaagtgtaaagaatgtgaaaagtcattttgcatgctttcacacttagctcaacataaaagaattcatagtggagagaaaccctacaaatgtaaagaatgtgggaaagcctataatgaggcctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccggttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcatcacaacttactacacataagataattcatactggagagaaaccctacaaatgtgaagaatgtggcaaagcttttaaccagtcctcaactctttctaaacataaggtaattcatactggagagaagccctacaaatgtgaagaatgtggcaaagcttttaaccagtcctcacaccttactacacataagatgattcatactggagagaaaccctacaagtgtgaagaatgcggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaacagtgtggcaaaacttacacaatgctcaaaccttattgcacaggaaagcctttatacttgatgagaacaaatgtacaaatataaagaaagtaaaaaagtgattaatatctgcacacatcttattcagcatcagagaatttatacttaatagcattaaaggtgcaattactgtcaaaagagttcagaaaatataagcatttaaagtgctgaagaggatttattttgaagacaaacattacaaatataaacgaagttgtggtaactttacttgtaacacagatcttgttgtattcattctgtattagagcaaaccctgaggcaattgc

SEQ ID NO: 35402 - DNA, 3114 bp, Homo sapiens
atgtctttttggtctgaaaaatgtacaagacttattctgtatgatttaaaaatagcactcaaaaatggatcgttgacattttgggatgtgaccatagaattcgctctggaggagtggcaatgcctggacatggctcagcagaatttatataggaatgttatgttagagaactacagaaacctggtcttcctgggtatcgctgtctctaagctagacttgataacttgtctgaagcaagggaaagagccttggaatatgaagagacatgagatggtaactaaacccccagttattagttctcattttacacaagacttttggccagatcagagcataaaagattctttccaagaaataatattgagaacatatgcaagatgtggacataagaatttacgattaagaaaagattgtgaaagtgtcaatgagggtaagatgcacgaagaagcttataataaacttaaccaatgttggacaactacccagggaaaaatatttcagtgtaacaaatatgtgaaagtctttcataaatattcaaattcaaatagatataagataattcatactgggaagaaaccatataaatgtgaagaatgtggcaaagcttttaagcaatcctcacaccttactagacataaagcaattcatactggagagaaaccctacaaatgcgaagaatgtggcaaagcttttaaccatttctcagcccttagaaaacatcagataattcatactggaaagaaaccctacaaatgtgaagaatgtggcaaagcttttagccagtcctcaacccttagaaaacatgagataattcatactgaagagaaaccctacaaatatgaagaatgcggcaaagcttttagcaatttgtcagcccttagaaaacatgagataattcatactggacagaaaccctacaaatgtgaagaatgtggtaaagcttttaagtggtcctcaaaacttactgtacataaggtaattcatactgcagagaaaccctgcaaatgtgaagaatgtggcaaagcttttaagcgtttctcagcccttagaaaacataagataattcatactggaaagcaaccctacaaatgtgaagaatgcagcaaagcttttagcaatttttcagcccttagaaaacatgagataattcatactggagagaaaccctacaaatgtgaagaatgtggtaaagcttttaagtggtcctcaaaacttactgtacataaggtaattcatatggaagagaaaccttgcaaatgtgaagaatgtggcaaagcttttaagcatttctcagcccttagaaaacataagataattcatactggaaagaaaccctacaaatgtgaagaatgtggcaaagcttttaacaattcctcaacccttatgaaacataagataattcatactgggaagaaaccatacaaatgtgaagaatgtggcaaagcttttaagcaatcttcacatcttactagacataaagcaattcatactggggagaaaccctacaaatgtgaagaatgtggcaaagcttttaaccacttctcagcccttagaaaacatcagataattcatactggaaagaaaccctacaaatgtgaagaatgtggcaaagcttttagccagtcctcaacccttagaaaacatgagataattcatactggagagaaaccctacaaatgtgaagaatgtggtaaagcttttaagtggtcctcacaccttactagacataaagtaattcatactgaagagaaaccctacaaatgtgaagaatgtggcaaggcttttaaccatttctcagcccttaggaaacataagataattcatactggaaagaaaccctacaaatgtgaagaatgtggcaaagcttttagccagtcctcaactcttagaaaacatgagataattcatactggagagaaaccctacaaatgtgaagaatgtggtaaagcttttaagtggtcctcaaaacttactgtacataaggtaattcatactgcagagaaaccctgcaaatgtgaagaatgtggcaaagcttttaagcatttctcagcccttagaaaacataagataattcatactggaaagaaaccctataaatgtgaagaatgtggcaaagcttttaacaattcctcaacccttagaaaacatgagataattcatactggagagaaatcctacaaatgtgaagaatgtgcccttagaaaacatgagataattcatactggaaagaaaccctacaaatgtgaagaatgtggcaaagcttttaacaattcctcaacccttaggaaacataagataatttatactgggaagaaaccatacaaatgtgaagaatgtggcaaagcttttaagcagtcctcacaccttactagacataaagcagttcatactggggagaagccctacaaatgtggagaatgtggaaaagcttttaacaattcctcaacccttaagaaacataagctaattcatactagggagaaatcgtacaaatgtgaagaatgtggcaaagcttttagcaatttctcagcccttaggaaacataagataattcatactggggagaaaccatacaaatgtgaagaatgtgaatgtggcaaagcttttaacaattcctcaacccttatgaaacataagataattcatactggggagaaaccgtacaaatgtgaagaatgtggcaaaggttttaacaatttctcgacccttatgaaacataagataattcatactggggagaaaccgtacaaatgtgaagaatgtggcaaagcttttaagcaatcctcacaccttactaaacataaatcaattcatactggagagaaaccctacaaatgtgaagaacgtggcaaagcttttagccatttctcacgccttactaaacataggataattcatactggaaagaaaccctacaaatgtgaagagtgtggagagaaaccctacaaatgtgaagaatgtggcaaagcctttaaccagtcctcacaccttactcaacataaaacaattcatactggagggaaaacctacaaatgtgaagaatgtggcaaagcttttaaccatctttcagcccttactaaacataagataattcatactggggagaagccctaa

SEQ ID NO: 35403 - DNA, 3345 bp, Homo sapiens
cgccgctcgccgcccgcgggttccattgagaaaagccgagcggccgcggcggcggcggcgagtgcgcgggagcggaggagccggcacccgcccgtcgggcagtccgcgcgcccgcaacgcaggaccgtggcctctcgggcctccgcggcagctccagcggctccggggctgggcgcgcgggctgggggcgcgggccggggcggccgcggagaccgggggccgggggcatgagcggccccgcggccccgccgcgcccccgccgcccgccgccgcccgcccggggctagaggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgagcccagccctgaccctgctgctggtggacgaggcctgctggctgaggacgctgccccaggccctgactgaggccgaggccaacacagagatccacaggaaggatgacgcactctggtgcagggtcaccaagccggtgcctgcggggggactcctgagcgtgctcctcacggccgagccccacagcacccccggccaccctgtgaagaaggagccagcagagcccacgtgcccggcccctgcacacgacctccagctcctgccccagcaggccgggatggcctccatccttgccaccgcagtgatcaacaaagacgtcttcccctgcaaggactgtggcatctggtaccgcagcgagcgcaacctgcaggcgcacctgctctactactgcgccagccgccagggcaccggctccccggccgcagccgccacagacgagaagcccaaagagacctaccccaacgagcgcgtctgccccttcccccagtgccgcaagagctgccccagcgccagctccctggagatccacatgcgcagccacagcggagagcggcccttcgtgtgcctgatctgcctgtcggccttcaccaccaaggccaactgcgagcggcacctcaaggtgcacacggacacgctgagcggtgtctgccacagctgtggcttcatctccaccacaagggacatcctctacagccacttggtcaccaaccacatggtctgccagcctggctccaagggtgagatctactcgccaggggccggacacccagcaaccaagctgcccccagacagtctgggcagcttccagcagcagcacacggccctgcaaggccccctggcctccgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagc

SEQ ID NO: 35404 - DNA, 3268 bp, Homo sapiens
agggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaatgacacttcatatgacacaaaatcagtcgtctggagtcccaagatctgtgttctagccatatctgatttttatctagctctatgaaaacacatgagtagcagacacatcttaagaggagaatagattctgaagttagtagaaatatcagattccacatgtctaacgtgaacatgtgccactgtttgcctggcttagtcccattgtacatttttatctggcatccctctggatggtgactcctttcctctacgaaagtcctgagtttgcacaatacaagaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccaga

SEQ ID NO: 35405 - DNA, 4700 bp, Homo sapiens
ctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaaagaaaatagtcacaatacagaaaagcattttagaaatagcttcaaaagcacttgtgtatcttgattttttcttatatgctgttgcagatatatgtatatgctaaaatataacttgcaaagatgttctaaatacacatgctataagttcgccttaagatttcaattcttggataatcaggctctgtttgcactttatattttagcagatacagtctcttagtcactaggctttgcatttgtatgtagctgtatgtttccgtccattttcttaatcctgaacctgtatgttaaatgaagatggcaatttttttcttgtatagtacttgtattttctttcgctgatgcagctctgtctcaatttttaaacctttgctgttaaatgcaatactttataaagaatgaacaaaattactggaagcagtattgtaagtaatgaggtagtattaatcagttttatcttttgaaaggcacagtctaaatcgaaaccctaaactcaatgctgcaagtatgaatttaattcatatataagatctatttaaatataagagtagcaatactgcacctggtgatcacaaagataatgttctacttctgatagaaataatttctcaacaaatgttgttactatgcatgtatatggatggaataaaattccagattgt

SEQ ID NO: 35406 - DNA, 3300 bp, Homo sapiens
agattcttagaagacccttcagagtctgaagtaaagaaagttttgaacctgttttttcattctactgtagggcttctgaaaacaaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtcc

SEQ ID NO: 35407 - DNA, 3960 bp, Homo sapiens
gtaaaagttcgcgcctctgcggcgggcggccgtgcgtctctgccctgcgggcgcgggctggtggctggcaggtcgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaa

SEQ ID NO: 35408 - DNA, 2996 bp, Homo sapiens
gtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtact

SEQ ID NO: 35409 - DNA, 2906 bp, Homo sapiens
gagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaa

SEQ ID NO: 35410 - DNA, 7558 bp, Homo sapiens
gccggcctgcagcacccgccaccgtcgccggccgcccgcacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacagacagtcttcctctgtcatccaggctggaatgcagtgcagtggtgcaaatttggctcactgcagcctctgccttctgtgttcaagtgattcttcttctgcctcagcctctcgagtagctgggattacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagtta

SEQ ID NO: 35411 - DNA, 7396 bp, Homo sapiens
ggcccagtgctccagagaaaggccggcctgcagcacccgccaccgtcgccggccgcccgcacgtccgtccggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 35412 - DNA, 300 bp, Homo sapiens
agtgctccagagaaaggccggcctgcagcacccgccaccgtcgccggccgcccgcacgtccgtccgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgt

SEQ ID NO: 35413 - DNA, 600 bp, Homo sapiens
gacggcgggcccgtgccggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgg

SEQ ID NO: 35414 - DNA, 7463 bp, Homo sapiens
agagaaaggccggcctgcagcacccgccaccgtcgccggccgcccgcacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatgcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 35415 - DNA, 7157 bp, Homo sapiens
agagaaaggccggcctgcagcacccgccaccgtcgccggccgcccgcacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 35416 - DNA, 6801 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccgtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 35417 - DNA, 2936 bp, Homo sapiens
gcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacagacagggtctcgttctgtcacccaggctggagcacagtggcgccatctgggtccactgcaacctccgcctcccaggctcaagtgatctgctcagcttcccgagtaactggggctacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgc

SEQ ID NO: 35418 - DNA, 2026 bp, Homo sapiens
ggaggttgcagtcaatatctgttactatttgtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgc

SEQ ID NO: 35419 - DNA, 5239 bp, Homo sapiens
gcctagtgcgcgcgcagtaacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatg

SEQ ID NO: 35420 - DNA, 5113 bp, Homo sapiens
gacggcgggcccgtgccggggagctgggccgctttttgtcagctccgaactcggcccctcctccctccctccgcccgccctaccagccggagcccggcccagtgctccagagaaaggccgtcctgcagcacccgccgctgtcgccgaccgcccgcacatccgtcgggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatga

SEQ ID NO: 35421 - DNA, 4749 bp, Homo sapiens
agtggtgacggcgggcgcgcggagaaaaggaacgttgtgacggaaactccagctgccggagaccccaccgcagtgaggtcactggactccccggactcggggcgtgaccggcgccgacccggggcgccgagaggcccaccgggcggagggggcccaactaccatcccgcattttcctgggtctctctcccgggcggtgacgtgacgtgctgacggcgggcccgtgccggggagctgggccgctttttgtcagctccgaactcggcccctcctccctccctccgcccgccctaccagccggagcccggcccagtgctccagagaaaggccgtcctgcagcacccgccgctgtcgccgaccgcccgcacatccgtcgggagctgtgactaatgagaattaaaggccatggatgaagatgaatttgaattgcagccacaagagccaaactcattttttgatggaatagtggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatg

SEQ ID NO: 35422 - DNA, 567 bp, Homo sapiens
tggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaa

SEQ ID NO: 35423 - DNA, 4997 bp, Homo sapiens
gcctagtgcgcgcgcagtaacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaagtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatg

SEQ ID NO: 35424 - DNA, 2294 bp, Homo sapiens
agtggcttctgtgccccgccctgcgggtggtttgctagtttcaagcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgt

SEQ ID NO: 35425 - DNA, 1794 bp, Homo sapiens
agtttcaagcactttgtgagtatggggtgaatcggcgtcggccttccactgtggggttaaatctcatcccgcggctctcctcctgtcggtcctgcagttcttttgtccccgggtagaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgt

SEQ ID NO: 35426 - DNA, 2313 bp, Homo sapiens
tcactccaggacatcctttgggaaccttactatgggattcaggtttggggtggtgtagaggattaagctgcagaaccactgaacatggagaaatttctgcagcagttccccagagatgtctctgggctcctgggcaggagagaagggactacttgcaagtttactggttaataatgatttcccacctttcagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgcta

SEQ ID NO: 35427 - DNA, 3576 bp, Homo sapiens
agtggcttctgtgccccgccctgcgggtggtttgctagtttcaagcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtagaaagaacaggtttagtatctgagcgctgtggcctgtttcctcctgaaatcccagatcagagtgaggggcattcctttaacatccaggagttcttcatctcttttttgtaccgtgaacctccttggcagtaaggtgaagtccctggactccttctcagaataattttttttttaaaatacataaaccataaaggattacaaaagaacgcagtcatatcaacatacagtttgcaaagtattaactttgtattaaagtcatacttttttttattagtacactaaataataaaacctacggacagggcttataactggcaattacaaagcagtgataagtatctctttgcttggttgtaatgtgatgtaaaaacatctgcaggttctattggtgacaaagtcgtgggtactgcttatgctacattgatttgttgcttccattcataattggaaggaaatgctaactttctcttaaagactagttaaaaataagattagcttttgtcctgttcaagttcatggactacgtgggaaggagttcatggaccactggttatgaacctctggtagaaaatgggccgacttttacctccatgttcttccctgttttatgagactgtgtcctctttgcatcatcctgtgtccctgtgcacacaccctcagaggacctgtgtggccagagccttctaaatggtgagctggataccagggttcttgacttgggtctgttgcacccaaggcctgtaacagtggaaagtcagtgcgagtctcttagcttcattctttataaaggatgtgggaaattctgagctgcacatgagaaagtaacttgaaaactgtaattttataataactataaatgtctggaaggaaacctgcatacatatcgtatgccaggccatgttaggtgatttcacgtactgtgatgttgtttgggtcccccaaactccataaactagagattgtaatccccttttcagataataaaaggtattaatattctctgagaattttgcaccagtttccaatggattttcataaaagcacaaatgtatatatgaaggagcatagagtaatgataagaacgtgtgctctggcatcattctacctgagctcccatcctagcattgccactgattagctatttaaactggctgtgccttaatttccctatcagtaaaatgggtataataataatacctcccttataagattgttgttttctgcgttaaatgagttaacatttataatgctcttggaaatagtgccagccacctaggtagttctatggaagtgtttgatgaaaacatgaaaataagaacaaatgatttctaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggattacaggtgtgtgccaccatgcccggctaattttttatgtttttagtagagacgggattttaccgtgttagccaggatggtctcgatctcctaacctcatgatcctcctgcctcagcctaccaaagtgctgggattacaggcatgagccaccatgcccggccaagaatccatatttctttaccagactaggaattctattctagtgcaaatgccttaaaaagcttatcactaaatcattacgaatgtgtgccatccgtggaattgcttttttttttttttttttgtaaatatgaggtctcactatgttgcccaggctggtctcgaaatcctgggcaatcctcctgcctcaccctctcaagtactggaattacaggcgtgagccaccatacccagcccaaatttcactctttaatgttttcctgttgctattctttaaggaaaaaactttcctattcagacagtgtgaaaatcagtcatcaagtcagaataaaatgatgaatattct

SEQ ID NO: 35428 - DNA, 990 bp, Homo sapiens
cgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtagaaagaacaggtttagtatctgagcgctgtgcgaggggcattcctttaaggtccaggagttcttcatctctttttgtactagctttcctcccatggcagggcataacccacagttgccggccatttgttgtttcaggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcat

SEQ ID NO: 35429 - DNA, 2375 bp, Homo sapiens
ccaaagacatcctttggtgatacttactgtgggattcagagtggggtgcagaggacgaccctgcaaaggcacggactataagagagatctgtgcagctgcgcctcagggggtgtcctgggcccctgggcatgacaggagggggaccacttgcagttctactggaaaatttaccacccttccagaatcctctgaagatatacaggtcgcaactagagtgagacccgagtactgccttgggtcagaatggctagagaaccgagaaaaaacgcagccctggacgcccagtctgcagaagaccagacggggctcctgaccgtgaaggtggagaaggaggaagcctccgccttgacggcggaggtgagagcaccctgcagccctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggttcccgttggtgaccaggggcaagaactgctctgttgcaagatggcactattgacacaaactcaagggtctcaaagtagccagtgccagccaatgaaggctctgttcaagcatgaatctctgggatcccagcccttacacgatagagttctccaggttcctgggcttgcccagggagggtgctgcagagaagatgcaatggtagcttccaggctcactccagggtcccagggtttgctgaaaatggaagatgtggccctgaccctcactcctgggtggacacagctggattcatctcaggtgaacctctacagagatgaaaagcaggagaaccatagcagcctggtctcccttggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatggtgataaaaatgttcagaatcctgagcacggggagtcctgggaaagtcagggtaggacggaaagccagtgggaaaatactgaggctcccgtgtcttataaatgtaatgagtgtgagagaagtttcacacggaatagaagtcttattgaacatcagaaaatccacactggtgagaaaccctatcagtgtgacacatgtggaaaaggtttcactcgaacttcataccttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagacgatgagttatcttctacattctagaaagtgattggaagaagtcatttgataagaggccatgggagagtggtctggaagttgtaggacctaaaatagtttgttctcacccagtgtatttaaatggccttctggacttgttaattgccctcagccagcactttaggacatctggttggatggctctgatgtggggggctgctgctctgaccattcattttgcctctaatgaatctttcacaaattggtcagatccatgaggtcttttactcttctttgtgccttgtatgataggtgctaataaacatttattaaatgtaccagtaaaatggcctttgtaccaaaaattt

SEQ ID NO: 35430 - DNA, 1472 bp, Homo sapiens
gcgtgtgctatgtggggcgggccttggctgcgtgaaggcttcttgtgggaagtaggttcccgttggtgaccaggggcaagaactgctctgttgcaagatggcactattgacacaaactcaagggtctcaaagtagccagtgccagccaatgaaggctctgttcaagcatgaatctctgggatcccagcccttacacgatagagttctccaggttcctgggcttgcccagggagggtgctgcagagaagatgcaatggtagcttccaggctcactccagggtcccagggtttgctgaaaatggaagatgtggccctgaccctcactcctgggtggacacagctggattcatctcaggtgaacctctacagagatgaaaagcaggagaaccatagcagcctggtctcccttggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatggtgataaaaatgttcagaatcctgagcacggggagtcctgggaaagtcagggtaggacggaaagccagtgggaaaatactgaggctcccgtgtcttataaatgtaatgagtgtgagagaagtttcacacggaatagaagtcttattgaacatcagaaaatccacactggtgagaaaccctatcagtgtgacacatgtggaaaaggtttcactcgaacttcataccttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagacgatgagttatcttctacattctagaaagtgattggaagaagtcatttgataagagg

SEQ ID NO: 35431 - DNA, 498 bp, Homo sapiens
cctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatgtggttacagaaattgtg

SEQ ID NO: 35432 - DNA, 860 bp, Homo sapiens
agatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 35433 - DNA, 968 bp, Homo sapiens
agatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgctcacccatgacagtctctgaatccaggccgttgggagatttcctcaccctggctcctggcgggctggcccagcgactcgggtactggttcacccggctcatgtgaacgcaatttcgtctgtgtggggtgctgcagctcttggttggtgaacacggaaaggttgctgtgtgtaactgcacagtgtgacgcgatgctccagtggtgcgacttcgtcaggatggatgaaggacacaggactgggaccccaagttacagaagcagctcgctcca

SEQ ID NO: 35434 - DNA, 1314 bp, Homo sapiens
gcgcgcgccgagggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgtacaa

SEQ ID NO: 35435 - DNA, 1159 bp, Homo sapiens
cagcgcgccgcgcgcgccgagggaggagcgggcgccgggggccggctggcgcgggggctccgaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatga

SEQ ID NO: 35436 - DNA, 944 bp, Homo sapiens
gagcgggcgccgggggccggctggcgcgggggctccgcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcggga

SEQ ID NO: 35437 - DNA, 2021 bp, Homo sapiens
gcgcgcgccgagggaggagcgggcgccgggggccggctggcgcgggggctccggtaacccgggctgggcgggggagaggaaggggcggggcagggagcccgccagagtgcggggtcgcggtgcggacttcgagcacgagccctaaagacgctcagcactcgtcgcttctcctagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgt

SEQ ID NO: 35438 - DNA, 741 bp, Homo sapiens
aaagacacccccctcctacctccccaccccccaaatatcccctggaggcaaaattgccctggtggatcaccactgatctaactgatagtaccctctggttatatgggaaaactgctaaacttggaagcaggaggcatctaaaatgagcttgtgtccgcaattggtgggttcttggtctcactgacttcaagaatgaagccgcagaccctcgcggtgagtgttacagctcttaagatggcgcgtgtggagtctgtcccttctgatgttcagatgtgttcggagtttcttccttctggtgggttcgtggtctcgctggctcagaagtgaagctgccgaccttcacggaagcaaggaggctacattggggaatggtgactttggtttgtgcgggcactctttttaaatcgtgggatgagaacatcacccagtgagaaagcccctgggctggtaatcagcacagagagcttagtcaggactataacccatcagtcagaaaaatatttgcctgggaagagagatactaccgtgagagcttcattcacttttatcgtggtcgctggggtctctgagcagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaag

SEQ ID NO: 35439 - DNA, 1520 bp, Homo sapiens
cagaccctgcccggcttggcgatggagtttccggacctcggcgctcactgttcggagccgagctgtcagcgcttggattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagcacaagcactgtcagccagtgaggcagaataccagcggcagcaggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccct

SEQ ID NO: 35440 - DNA, 3366 bp, Homo sapiens
gttacggagacagcagggcccggggcttcagagcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaa

SEQ ID NO: 35441 - DNA, 5728 bp, Homo sapiens
ctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatggaagtaagagtggtatagagaaggtaagatgagccctcggactccatcactctgaaggtctgagtagtagcaagagatagatttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagttttttttgttttttttttgtttgtttgttttacaagaaacattaaaccagatcagaacaaagatttgtcagggttgtccattgactggggagaaagggaatcagtgtgtaaggcacctgagaggactcagttctacccaaattcttgcattcaaacctgaatgcaaggccatgaagtcctttgaaatgtacagatattaagcaatttaataatataccatgtttcccttacataagcagacaaatatttacacccccatgacctgaagttttgttaggctgtgaccacatgaattcgcagtataaatgggtgagtcctttttgaaaacctcatcttcagtgtgcctgatctgtaaaactagagcctcaggtttgatcctaggtaggcttcccacaacgtggggaaaattagtttgtgagggaaagctgtttctgagcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatttgttatttaaacttgcagtttaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatggtctcagctcactgcaagttccgcctcccgggttcacgccattctcctggctcagcctccggagtagttgggactacaggcacccgtcaccacacctggctaatgttttttgttttttgggtttttttgtatttttagtagagagagggtttcaccgtgttagccagggtggtctcgatctcctgacctcatgatccgcccaccccggcctcccaaaatgctgggattacaggtgtgagccactgcgcctggccgactcttgtctgtttgaatgcaaagttctcaatagtggtttttgtccataagtattaacttataattttggagagtgataggtatggttgctggttgattagcaataagattatgtagccttaaactagctagaagagtttgcatgggtgaggcaacaggctgttaacaaaaagaaactggaaatacagtttcccctgtttgtttctcctgtttgtacaatctgctttaaaaacaagtgaacatgcaccatgtcagtcatggtgaatcggccaacagccagcccttgccagttgacatcacagtctaagatgggaaactggtacagatagacatgaagagagcttagcagtggttgaggtggtgactaaatatacagtcattgaataaataccgtgtagcaaatgtaaaaaaaaaaaaaaaagtacaacagaatacaaaagtgccatttaatattttatagctatttctatgcacaagtgctggttttaaatttatataaaagcaaagactgtttctgtgttttcttccagagtatttctgttacagccatagaagtaaagttaataaatgtaagactttttttgttt

SEQ ID NO: 35442 - DNA, 1073 bp, Homo sapiens
ccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttg

SEQ ID NO: 35443 - DNA, 690 bp, Homo sapiens
ggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacgcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaaga

SEQ ID NO: 35444 - DNA, 2686 bp, Homo sapiens
acagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 35445 - DNA, 2785 bp, Homo sapiens
gggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 35446 - DNA, 1814 bp, Homo sapiens
aataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgta

SEQ ID NO: 35447 - DNA, 1472 bp, Homo sapiens
ggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 35448 - DNA, 1559 bp, Homo sapiens
cgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccagatcaaaagacactgacttagctgcttaccagaaggggaacttgggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 35449 - DNA, 1602 bp, Homo sapiens
ggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttga

SEQ ID NO: 35450 - DNA, 1446 bp, Homo sapiens
gctttggagtacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 35451 - DNA, 891 bp, Homo sapiens
ggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgac

SEQ ID NO: 35452 - DNA, 2832 bp, Homo sapiens
gcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaa

SEQ ID NO: 35453 - DNA, 4485 bp, Homo sapiens
cgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgc

SEQ ID NO: 35454 - DNA, 4510 bp, Homo sapiens
cgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtc

SEQ ID NO: 35455 - DNA, 947 bp, Homo sapiens
ctgcgggtctacgcggtaggcgccgcggtgatcctggcgcagctgctgcggcgctgccgcgggggcttcctggagccagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatgg

SEQ ID NO: 35456 - DNA, 5257 bp, Homo sapiens
gcgcagcgtccggcggcgtcgcgggcggcgggcggcggggccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccagagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagtgtgtctgccgtgtcctcgttcccctctccctcactcctgcttccaccacagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccagtaaagccggtcagagagtccccttcggcctcctcctcccctgacaggctgactgaggacttgcagtctcacttgaaccctggagatgggctgatggaagacgtggcggccttctcatcttccgatgacataggggaggcctcggcgtcctctcctgagaagcagcaggctgatgggctgagtcctagattgtttgaatctggcgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggctgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaaaccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaatttt

SEQ ID NO: 35457 - DNA, 4250 bp, Homo sapiens
agcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaatagttaatttcagaattaagggaaattgatgtcgctatcatgaggcatcataaaaatatgtattttacaaggtgaaggcatttcaagtagatatagttcttgatgaagcaggaagaacatggatctgggatttggaagacctggcttctagctgctactaaccaactctgtgactctgggaaagggggactcagttcttacttctgtaacatgaggacactggactatttgaattcagaacttagaaaattggaagggaccttaaagccctctaagaaagagttcgggaatgttctccattgctgtcagttttcctccaaaaataacctggcttggaagttattggtccagtgggaatttgattccccatagaaactggagaaaaggtaatgcaagtagagaggaacagctgtatttctgcttgagtaataaacccactaacagattctggtacgaattgtggagacataaagagaatgagtgtatgtactctaagtgtaccagtttcttcactctctcctggcagaagatgcaacacttttagtgattctgggattctgggatgtgttcctattaattctaatacagatgaagaagatgtggtagaggaaaagatggtagcagaaggagtgaataaagaggcaaaacagcctgctaaaaagaaaagaaagaagggtttgcgaattaaggggaaaaggcgtcgaaaaaaattgattcttgccaaaaagtttagtaaggatttgggatctgggaggcctgttgcagatgcccctgctttgttagcttccaatgaccctgagcaggatgaagaaagtctttttgagagcaatatagaaaaacagatctatctacctagtactagagccaagacctccattgtgtggcacttctttcatgttgacccccagtacacctggcgggccatttgtaacctctgtgagaaaagcgtcagcaggggtaaaccaggtagccatcttggtacatctactcttcaacgacatctgcaagcaaggcattcacctcattggaccagggccaacaagtttggagttgctagtggagaggaggactttaccttggatgtgtctttatctccctcttctggaagcaatggaagctttgaatatattcctactgatccattagatgataatagaatgggcaagaagcatgataaatcagcatctgatgccctaagggcagaaagagggagatttctcatcaaaagtaacattgtcaagcatgctttaattcctggaactagagccaagacatctgccgtttggaattttttttacactgatcctcagcacatctcaagagctgtgtgtaatatatgtaaaagaagtgtgagccggggtaggccagggtcccacttagggacttcaacacttcaacgacacctgcaagccacacatcctatccattgggctgttgccaacaaagacagtggtgctgttgcaaatggattagatgaagctgagactgagagaagtgatctcttgagtgataccttgcatggagaaaagtctacaggcagccaagatttaacagctgaggaccttagtgactctgattcagatgaacctatgttagaggttgaaaacagatctgaaagtcctattcccgttgcagagcaaggcactctgatgcgtgcgcaggagagagaaacaacatgttgtggaaatccagtctcaagtcacataagtcaggcaattatccaaatgattgtggaggatatgcatccttacaactatttctcaaccccagcctttcagaggttcatgcagattgtggcccctgattataggttgccatcagagacttactttttcactaaggctgtacctcagttatatgattgtgtcagagaaaaaattttcttaactttagagaatgttcaaagccaaaagatacacctgactgttgacatatggacccatgacccatccactgactattttattgtgactgtacactgggtttctttggaaactgcgtcttttctcaataatggcaggatccccgattttagaaagtgggcagtgctttgtgttacaggtttggctaaagactgtttgataaccaatattttacaagaattaaatgaccagattggtctgtggctttctccaaatttccttatccctagcttcattgtttctgacaattcctctaatgtggtacatgcaatcaaagatggtggttttacccatgtgccatgcttcctgcattgtttaaatatggtcattcaggactttttctgcgagcacaaaagcattgagaatatgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttcaggttctgttgatagctcagctgtagacaatgttgcccttggaagcaaaagcttcatgttcccttctgctgtagcagttgtggatgagtacttcaaagagaagtattcagagttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacaca

SEQ ID NO: 35458 - DNA, 5743 bp, Homo sapiens
gccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagcagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagagttaaa

SEQ ID NO: 35459 - DNA, 5858 bp, Homo sapiens
cacaatgcagttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttggggttagtccttcgagatcaaagtcattgcaaagcaaaaaaatttcctaattcaccggtgaaagccgaaaaggcaaccatttcacaggcaaaatcagaaaaggcaaccagtttacaggcaaaagcagaaaaatcaccaaagtcacctaattcagtgaaagcagaaaaagcatccagttatcagatgaagtcagaaaaagtaccaagttcaccagcagaagcagaaaagggacccagtttactgttgaaagacatgagacagaagacagaattacaacagattggaaaaaaaattccaagctcctttacttctgtggacaaagtgaatattgaagctgtagggggagaaaaatgtgctctgcaaaactcaccacgatctcagaagcaacagacatgtacagataatactggtgattctgatgatagtgcttcaggaattgaagacgtatcggacgatttaagtaaaatgaagaatgatgaatctaataaagaaaattcttcagagatggactacttagaaaatgccactgtgatagatgaatctgcattgacacctgagcagaggctggggttgaaacaagcagaagaacgcttagaaagagatcacatctttcgacttgaaaaacgatcaccagaatataccaattgtcggtatctatgcaaactttgcttaattcacattgaaaatatccagggggctcataaacatataaaggagaaacgacataagaaaaatattttggaaaaacaagaagaaagtgagcttcgttctctgccacctccttcccctgcccacttggctgctttaagtgttgcagtcattgaattagcaaaagaacatggaataacagatgatgacctcagagtccgtcaggaaattgtggaggaaatgtcaaaggttataacgacatttttaccagaatgttcacttaggttgtatggctcatctctgactagatttgctctgaaaagtagtgatgttaatatagatataaaatttcctcccaagatgaatcatccagatcttctgataaaagtacttgggattttaaagaaaaatgtattatatgtagatgtggaatctgattttcacgctaaagttcctgttgtggtgtgcagagatcgaaaaagtggtttactttgtagagtgagtgcaggaaacgatatggcatgtctcactactgatttacttactgcccttggcaaaatagaacctgtctttattcccttggtgttagcctttcgctactgggctaagttgtgctatattgactcccaaactgatggtggaatcccttcttactgttttgctttaatggtgatgttttttctacaacagagaaaaccccctcttcttccttgcttacttggaagttggattgaaggctttgacccaaaaagaatggatgactttcagctgaagggcatagtagaagagaagtttgtgaagtgggaatgtaattcaagtagtgcaactgagaaaaactcaattgctgaggaaaacaaagctaaggcagaccaaccaaaagatgataccaagaagacagaaacagacaaccaaagtaatgccatgaaggaaaaacatggcaaatctcctttagcattggaaacaccaaatcgggtatccttgggacagttatggttagagctgcttaaattctacacactggattttgctttggaggaatatgtcatatgtgtacggatacaagatattttaacaagagaaaataaaaactggcctaaaaggcgaatagccattgaagatccattttcagtcaagaggaatgttgcacggagcttaaacagccagctggtttacgaatatgttgtggagagatttagggcagcttatcggtattttgcctgtcctcagacgaagggtggaaataagtctacagtggatttcaagaaaagagagaaggggaaaataagcaataagaaaccagtcaagtcgaacaatatggcaaccaatggttgtattctgcttggggaaaccacagaaaaaataaatgcagaaagagagcaacctgttcaatgtgatgaaatggactgtacatcacagagatgtattattgacaacaacaatttgttggtaaatgaactagattttgctgaccacggacaggactcttcatctctttctaccagcaaaagcagtgaaatagagccaaaattagataagaaacaagatgatttagcgccttcagaaacttgtttaaaaaaagagctcagccaatgtaattgcattgatttgtctaagtcgcctgacccagataaatctactggaacagactgcaggtcaaatttagaaacagagagttcacatcagagtgtgtgcaccgacacatctgctacctcttgcaactgcaaagctacagaagatgcttctgaccttaatgatgatgataacctccccacccaggaattatattatgtgtttgataagtttattttaacctctggcaagccaccaacgatagtatgcagcatctgcaaaaaggatggccattcaaagaatgattgcccagaggattttaggaaaattgatttaaaacctctaccaccaatgacaaaccgatttcgggaaatacttgatttagtatgtaaaagatgttttgatgagttatcaccaccttgttctgaacaacacaacagggagcaaattttaattggcttggaaaagtttattcaaaaagaatatgatgaaaaggcaaggttgtgcttatttggctcttctaagaatggatttggatttcgtgatagtgatctggatatttgtatgaccctggaaggccatgaaaatgcagagaaattaaattgtaaggaaataattgaaaatttggcaaaaattcttaagagacatccaggtttaagaaacattttgcctataactactgccaaagtgcctatagtaaaatttgaacacaggcgaagtgggttagaaggcgatatcagtttatataatacgttggctcaacataacacaagaatgctagctacttatgcagctattgatcctagagtgcagtatttgggatatactatgaaagtgtttgctaagcgatgtgacattggggatgcttccaggggaagtttatcttcatatgcatatatccttatggtgctgtactttctgcagcagagaaagccacctgttatcccagttctacaagagatctttgatggaaaacagattccacagagaatggttgatggatggaatgctttcttctttgataaaacagaagaactgaaaaagcgtttaccttcacttggaaagaacacagaatcattaggggagctttggctgggactgcttcgtttctatactgaagagtttgatttcaaggaatatgtaattagcattcggcagaaaaagctgttgacaacttttgagaagcagtggacttccaagtgcattgcaattgaagacccttttgacttgaatcataaccttggtgctggagtttccagaaaaatgaccaatttcatcatgaaagcatttatcaatggaaggaaactttttggtacccctttttatccactcattggcagagaagctgagtacttctttgattccagagtattaacagatggagaactggctcccaatgatagatgttgccgtgtgtgtggaaaaataggccactacatgaaagactgccctaaaaggaaaagtttactgtttagactaaagaagaaagacagtgaagaagagaaggaagggaatgaagaagagaaagattcccgagatgttcttgacccccgagacctccacgatactcgagactttagagacccgagagacctcagatgttttatatgtggagatgctggacatgtacgaagggagtgcccagaggtcaagctggcccgtcagaggaatagcagtgtggcagcagcccagctggtccgcaaccttgtaaatgctcaacaggtggctggttcagctcagcaacagggtgatcagtccataaggactagacagtcatcagaatgttctgaatcaccatcttattctcctcagcctcagccatttccacagaactcttcccagtcagctgctattactcagccttcatctcagccaggatcccaacctaagcttggcccacctcagcagggagcccaacctccccatcaggtccagatgccactgtataactttccccagtcaccaccagctcagtattctcccatgcacaatatgggattgttgccaatgcaccctctccagatccctgccccgtcctggcccatccatggcccagtgatccactctgcaccaggcagtgcccccagcaatattggcctaaatgatcccagcatcatctttgcacagcctgctgccagacctgtggcaatccctaacacgtctcacgatggacactggccccgtactgtggctccaaattccctggtaaacagtggtgcagtggggaattcagagccaggctttcgaggactgactcctccaattccttgggaacatgcaccgcgtccccatttcccccttgtcccagcttcgtggccttatggtttgcatcaaaacttcatgcatcagggaaatgcccgattccagcccaacaaacctttctatactcaagacagatgtgccacccgtcggtgtagagagcgttgtccccacccaccaagaggaaacgtgtcggagtaatgcgagtccattttctttcagctggtctaccgatgcacagcaaccagccaatcctgctgtctcaagggtatccgtacctcaatgtcagttacattcagcagaaaaagtgacatttaatggaaagcaaaacaaatcaggtcctgatttaaaattttaacacgtttagatagcttatttaaattctaagactgtttttacagactgtattatttgtatataaatatgaactatagtttttactagtatcaccaaattgagtgatacaaatttcatctattttattaccctatttttaagggaattttatgttttgtttaaccttgatgaattgtataaagagagaatttaaaaaattacattctttattttctattagctgtattcatactttggttgcttcagactttatatattgttcttaaaagttaggaaagaatttcatgtgttttaaattgtcacttctattctttacagaaccttgtagtgccaaaaactttttaaaaggtaaaaaaataaaataaaattacaacatgaagattcagattttttttcttttccatacttgtatattgaacattcaaacttgaatggaaagttgattttgtctgtatttgaagtacttctattttaagttaataaatctttttgacaagagttaaa

SEQ ID NO: 35460 - DNA, 883 bp, Homo sapiens
ggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagacagagtcttgctctgttgcctaggctggagtgcagtggcatgattgcagctcactgtagccttcacctcccaagtgcaagtgatcctcccacttcagcctcctgagactgggactacagagccagctgactatgcaacaagatgactatgcaacaagatgaatgaggagatatctacagcaggcttattgcttggaaatttcagaataccaaagcaaagagatcatcctagaagttttcttagagaaaaaaacagcctgaacgacagagcaagaccatgtctcaagaaagaagaagaagaaaaagattactcaaaatgaaaacctgtcaattttctgagcctgggactctccgggtacattgatctatattagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgctgccaaccttccaggtcctaaagatttgggg

SEQ ID NO: 35461 - DNA, 539 bp, Homo sapiens
ccctcctcgcgagctaacgagtgtctctcgcgcgctcccttccctccgcgtgggtttcgcggcgcggcggacatggcggtggagtcctgagctagtcgtgtcccggcctccagcggcggcagcggcgacggcggcggcagcaggaggcggagggagagcaggagccactgagatgaggaggcgtcgcgcgcgcctgtagctcgcgggcctcgcagtttgcttgcctaaactggacttgaagcaatttaaactactggagatctgccattttataatatcacaattggaaagaaacagattttcaaataatggaagagtctaaaaccttaaaaagtgaaaatcatgaaccaaagaagaatgttatttgtgaagaaagcaaagcagttcaagttataggtaatcaaacattgaaagctagaaatgataaatccgtaaaagaaattgagaacagctctccaaataggaatagtagtaaaaaaaataagcaaaatgatatttgtatagaaaaaacagaagttaaatcatgtaaagtaaatgct

SEQ ID NO: 35462 - DNA, 2231 bp, Homo sapiens
agaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggccatcaaagccgcatctgaacttgaattctgtgcagctgattgcagagctggacccggatctgcgaccccctgtggacagaggttgaccgtaccccggagaggagctttctcacggagggcactggttgcagaggctggaagtgaaataaagacgcgctcttgtttcagagttcgtcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagca

SEQ ID NO: 35463 - DNA, 2785 bp, Homo sapiens
ggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagctctgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaaagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacatggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaa

SEQ ID NO: 35464 - DNA, 938 bp, Homo sapiens
ctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtggaaggtacttgaagtttattgagttgcccttgactcagagaaagttttgtcaaacatgtcagcagttgttgttaccagatgactgggggcaacatagtgagcatcagttctgggtatgtgtcattaccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaaggtgtataatttattactgcaaaataaatacatatctatatatc

SEQ ID NO: 35465 - DNA, 2283 bp, Homo sapiens
gggcgccagcaggaagtgggagaagaggcgacccaaggcgggctggcgggctggcggcagtcgctacttgcctagtagcctcagccgctgtgggctcctggggagatggaggggccggggctgggctcgcagatacggaatttttgaacgatgtaaagagttggtagaagcaggatatgatgtcaggcaaccagataaagaaaatgtgtcgcttcttcattgggctgctattaacaacagactggatcttgtaaagttttatatttcaaaaggtgctgttgtagatcagttgggtggagatttaaattcaactcctcttcactgggccatccgacaaggacatttacctatggtcatattattactccagcatggtgcagaccccactcttattgatggagagggattcagcagcatccacctggcagtattgtttcaacacatgcctattatagcatatctcatctcaaagggacagagtgtgaatatgacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctagtaacactgttttttctgacatctttgtttccaaggttcttggttgggtataagaaccttgtatacttaccaacagcctttctgctaagttctgttttttggatatttatgacttggttcatcttattttttcctgatttagcaggagcccctttctatttcagtttcattttcagcatagtagcctttctatactttttctataagacttgggcaactgatccaggcttcactaaggcttctgaagaagaaaagaaagtgaatatcatcacccttgcagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgta

SEQ ID NO: 35466 - DNA, 2445 bp, Homo sapiens
gcagcggcggaggtgagggcgccagcaggaagtgggagaagaggcgacccaaggcgggctggcgggctggcggcagtcgctacttgcctagtagcctcagccgctgtgggctcctggggagatggaggggccggggctgggctcgcagtgcaggaatcacagccatggcccccaccctccaggatttggtcgatatggcatctgtgcacatgaaaacaaagaacttgccaatgcaagagaagctcttcctcttatagaggactctagtaactgtgacattgtcaaagctactcaatacggaatttttgaacgatgtaaagagttggtagaagcaggatatgatgtcaggcaaccagataaagaaaatgtgtcgcttcttcattgggctgctattaacaacagactggatcttgtaaagttttatatttcaaaaggtgctgttgtagatcagttgggtggagatttaaattcaactcctcttcactgggccatccgacaaggacatttacctatggtcatattattactccagcatggtgcagaccccactcttattgatggagagggattcagcagcatccacctggcagtattgtttcaacacatgcctattatagcatatctcatctcaaagggacagagtgtgaatatgacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctagtaacactgttttttctgacatctttgtttccaaggttcttggttgggtataagaaccttgtatacttaccaacagcctttctgctaagttctgttttttggatatttatgacttggttcatcttattttttcctgatttagcaggagcccctttctatttcagtttcattttcagcatagtagcctttctatactttttctataagacttgggcaactgatccaggcttcactaaggcttctgaagaagaaaagaaagtgaatatcatcacccttgcagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgta

SEQ ID NO: 35467 - DNA, 897 bp, Homo sapiens
tcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaac

SEQ ID NO: 35468 - DNA, 5796 bp, Homo sapiens
cacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagtgttttttaaagacttttttgtcagggtgcagtaaaattctccaattacttttattcatttatctgcttcctagttttattttagcctttatgagttattttatgatgaaagaaaatctataagcctaagttatggcccataggttttgttaagggttttcagagtgattttcaggtttaatttcactgcctttcataagggtaaagtttcacagctgacattagcctgaggattagcactaaagagctgtgttttcatagcaggggctattgtacagacagtgataaccaaatagtaatatgccagttctttcttctttttttagcttcagtagtagctaagccattaatacagtttgcatcaatttccccatttatttataatcagcctttcttttagtcctagtgcctgaatcaatgagtgagaatactagtactgattctttacaataataatatcttaagagtattgatatctttcattttttcatccagcagtctagtgcccagctgctgacaataaaagctccaactcttttagagatcagtggaatttagaagcatcttacaggtatcaaggaattgagcttctagagggatggtttggcttactaatttatcttccctgaaatatgtttgagtaaaaaagagttgcctgccacaatttagtgttggggttccagtggagctgagaaagtgaacaatccagctacttaaagcaacaacaaaacctgttcatctggatccctaggtaattttgaccaaggtgagacttttggcataaattaaatggattgtggtcagcattacatttgagagaatactagacatgactacacttattagggctagtgactttctcaaactcagaagctaaaaagcagcctagatgactatgcacacactgggtttcaagatgaaatcttcttatatattcagatggaaaaaaatttccccttacactctttctcaaaatactctcatttcggtttttcctgaaaccttatttggccattcccatggttttatgacagacaagccttgtcttctattcatatagatatgcacctttttctacatgtatggcctttacttactacacagcaagtaggcctcaaagtaatcttcctctttcccatcaatcatcttctgccaagcattcaggcagagcagctgttaactgtgattcaaagtcagaaaaacatcaagaacttctttgatgcatagggtgtatcagcactcagctcccacagaagtcaagtcacaaaatatagtgtcagttaactataaggaagttccggagaggtaaagctcaggaaagatgtaatgcaaagctgattgtttaatgtcttacagatttacactgtctttaaaaggccaaataaggctgggcgcagtggctcacacctgtaatcccaacattttgggagcccaaggcggccggaccacctgaggtcgggagttcaagaccagcctgaccaacatggagaaaccctgtctctactaaaaatacaaaaattagccaggagtgttggtgcatgactgtaatcccagctactcaggaggctgaggcaggagaatcgcttgaacctgggaggtagaggttgtggtgagctgagatcgtgccattgcactccggcctgggcaataagagtgaaactctgtctcaaaaaaaaaaaaaaaaaaaaaaaaagccaaataaatcagggttttaccaggggctcagagataaaaagaaaacctattcctatcttagcattttggtctcattggtttatagactctgataatatccctatccatggatcatttgagtattgactaatgtacataggtacccaactggttgattattaatcaagaatacagaactttatttaataattagcacaccctgatctggcttctttgcttgcttttctttggatccctgtccaataacctctgtggaatctcattccctaattgttgatactcattttctccgtttgcaaaatgaagatactcattgttaggatcctactgctgaagggtgctatgtcactttctagtgctcttatatgtctttaattataggactggaatgaaaagcttaaccatacagtatttctaagcaaaataatgtactccattcttttgtccatgctctcattgctgatttgttcttgcaggacttagagcactttgttaatgttcttccattcactccaacagcgtcctcagaaagagacagaataaaaaaattgttccccatggtacagctggaaaaattaaggggaaaagagattaagtggtccccaatggaacacagctgtcttatgcagggctcacagttaccatgttcagtacattgttaaagtaacttggcttcccaggactggaattatcatggagcagttagaattttgagagtaattacaacaggatcacattctgaaagagtcacattttgtcaaaaatctgaaaagtatgcaatttgtacaactcttactttctatgtgataagaatgcaatatgtgcctctttcccctactagccccatgtgacacatatttttcacactatgtggcatcaaccagtgccattacctcctgtggcaccatagagcccaatctcagggcagacattgccaaggtaaagaatgcactccatgtttataccaaattgcacaaagtatagacattgaggttaatggagatttaagcacaatcctagcaagtaagttttaagaatactgaatattatacattattgtaacatgaacctaaaattaatttaacagggcccaaattcataggaatgtaacagtcattgaaagcctattcttttcacctctcatcacacatatctacatacatgtatgcacatgtacacacacacacacacacacacacacacacatacacattttctccaaagcaggctgcctcttcagcaggagcaaatactttaatttaaaagaatgattatctgttttctccttttagaaaaagagtctaagaaacacagcatgtgaagaacattagatttatacattccagaatctctgctctcagagtagctaagagattcggtacagaagacgttctatggagaagcacagggggcatctaatgagattgtcaggcccttggacaagatccatattcttagaaaattaatgagttccatctcgttaggaattggttgatgaggtatggtacatctgcatttctttaaccatagctgtaatgtaccatattaaattgtagccttttgcatgcgggtattatataataatgaatgggtggctcctagtagcatgcaacccatgactgtttacttccctaaaagggttaggtctgtgtcctgcacagtgttcaaaaccattaaatgtgttctttgtagcaggatggtacacagccatcagcagaatgagttaaaaccaacaatgaattcaatataccaggaaatagattgttagtagggaatggcattaaaggaaaaaaaaattagataagatgcattcaaggaataattactttcactctgctggcttaatcagtgaaggaacataaaaggaaagctggcagtgggtcttggtaatatatgaactatattagagtgccagaaaaggagacctcagaagttaagcataggttgccaatctgctacaattatttttcccaccaatctgctcaaaatgattgtatatagtattcttaaaaccatgtgtcttggtgcagaaatattgacaaatgctggccagctttatcttcctatatccttcattaaaagtatatgcatataa

SEQ ID NO: 35469 - DNA, 6012 bp, Homo sapiens
gtgtgtaactgtgggggggggtagcagggggagagaaagagaacgaagggagacagagagactgagacagaaacaaagagggcggacgcagtgcagtaagagcagatgggcggacccaaatttcttcggcttcacgattttgcggaggtctagccctgcatccagccttgaaacagggtggggaggaggcagaaaggggagggactgcactccctctgagcgtgctagctccgactgcctgacggatcacccttccgctccaacatggctagttcctcaacgccgtgactcaagcctgttgtgccaggcagggcgcactcagcagcgcagccccacaggtggcgaaggctccgcgagagggttcccgccaggctagacagtggagtgccgcacagcgcgccttccagcctcgcagccgccaccctagcggttccgacccggcgccagcaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaagattatccagaaggctcatcatctcttgctgtggaaacggaaacatagcagttttcacatttcctgcatctctcagacaggactcaccatctctgcctcccatgaggcttacagagttcaatgttggaaatcattgtaatcttcaaaataagtcaccgtgttggattgaaagcttcaaaatttgaaagaattccatcaaatacttgctgtgtaaatgtttctggactttatgttatttaatttactgactgaaatccaatttggaatttggtagcagttaattcaagccaattttttttgtttcttcatttcccctcccccaatccatgaaagcctaaatgtaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaattcaggacataaactttattgaacataataaccagtgttttttaaagacttttttgtcagggtgcagtaaaattctccaattacttttattcatttatctgcttcctagttttattttagcctttatgagttattttatgatgaaagaaaatctataagcctaagttatggcccataggttttgttaagggttttcagagtgattttcaggtttaatttcactgcctttcataagggtaaagtttcacagctgacattagcctgaggattagcactaaagagctgtgttttcatagcaggggctattgtacagacagtgataaccaaatagtaatatgccagttctttcttctttttttagcttcagtagtagctaagccattaatacagtttgcatcaatttccccatttatttataatcagcctttcttttagtcctagtgcctgaatcaatgagtgagaatactagtactgattctttacaataataatatcttaagagtattgatatctttcattttttcatccagcagtctagtgcccagctgctgacaataaaagctccaactcttttagagatcagtggaatttagaagcatcttacaggtatcaaggaattgagcttctagagggatggtttggcttactaatttatcttccctgaaatatgtttgagtaaaaaagagttgcctgccacaatttagtgttggggttccagtggagctgagaaagtgaacaatccagctacttaaagcaacaacaaaacctgttcatctggatccctaggtaattttgaccaaggtgagacttttggcataaattaaatggattgtggtcagcattacatttgagagaatactagacatgactacacttattagggctagtgactttctcaaactcagaagctaaaaagcagcctagatgactatgcacacactgggtttcaagatgaaatcttcttatatattcagatggaaaaaaatttccccttacactctttctcaaaatactctcatttcggtttttcctgaaaccttatttggccattcccatggttttatgacagacaagccttgtcttctattcatatagatatgcacctttttctacatgtatggcctttacttactacacagcaagtaggcctcaaagtaatcttcctctttcccatcaatcatcttctgccaagcattcaggcagagcagctgttaactgtgattcaaagtcagaaaaacatcaagaacttctttgatgcatagggtgtatcagcactcagctcccacagaagtcaagtcacaaaatatagtgtcagttaactataaggaagttccggagaggtaaagctcaggaaagatgtaatgcaaagctgattgtttaatgtcttacagatttacactgtctttaaaaggccaaataaggctgggcgcagtggctcacacctgtaatcccaacattttgggagcccaaggcggccggaccacctgaggtcgggagttcaagaccagcctgaccaacatggagaaaccctgtctctactaaaaatacaaaaattagccaggagtgttggtgcatgactgtaatcccagctactcaggaggctgaggcaggagaatcgcttgaacctgggaggtagaggttgtggtgagctgagatcgtgccattgcactccggcctgggcaataagagtgaaactctgtctcaaaaaaaaaaaaaaaaaaaaaaaaagccaaataaatcagggttttaccaggggctcagagataaaaagaaaacctattcctatcttagcattttggtctcattggtttatagactctgataatatccctatccatggatcatttgagtattgactaatgtacataggtacccaactggttgattattaatcaagaatacagaactttatttaataattagcacaccctgatctggcttctttgcttgcttttctttggatccctgtccaataacctctgtggaatctcattccctaattgttgatactcattttctccgtttgcaaaatgaagatactcattgttaggatcctactgctgaagggtgctatgtcactttctagtgctcttatatgtctttaattataggactggaatgaaaagcttaaccatacagtatttctaagcaaaataatgtactccattcttttgtccatgctctcattgctgatttgttcttgcaggacttagagcactttgttaatgttcttccattcactccaacagcgtcctcagaaagagacagaataaaaaaattgttccccatggtacagctggaaaaattaaggggaaaagagattaagtggtccccaatggaacacagctgtcttatgcagggctcacagttaccatgttcagtacattgttaaagtaacttggcttcccaggactggaattatcatggagcagttagaattttgagagtaattacaacaggatcacattctgaaagagtcacattttgtcaaaaatctgaaaagtatgcaatttgtacaactcttactttctatgtgataagaatgcaatatgtgcctctttcccctactagccccatgtgacacatatttttcacactatgtggcatcaaccagtgccattacctcctgtggcaccatagagcccaatctcagggcagacattgccaaggtaaagaatgcactccatgtttataccaaattgcacaaagtatagacattgaggttaatggagatttaagcacaatcctagcaagtaagttttaagaatactgaatattatacattattgtaacatgaacctaaaattaatttaacagggcccaaattcataggaatgtaacagtcattgaaagcctattcttttcacctctcatcacacatatctacatacatgtatgcacatgtacacacacacacacacacacacacacacacatacacattttctccaaagcaggctgcctcttcagcaggagcaaatactttaatttaaaagaatgattatctgttttctccttttagaaaaagagtctaagaaacacagcatgtgaagaacattagatttatacattccagaatctctgctctcagagtagctaagagattcggtacagaagacgttctatggagaagcacagggggcatctaatgagattgtcaggcccttggacaagatccatattcttagaaaattaatgagttccatctcgttaggaattggttgatgaggtatggtacatctgcatttctttaaccatagctgtaatgtaccatattaaattgtagccttttgcatgcgggtattatataataatgaatgggtggctcctagtagcatgcaacccatgactgtttacttccctaaaagggttaggtctgtgtcctgcacagtgttcaaaaccattaaatgtgttctttgtagcaggatggtacacagccatcagcagaatgagttaaaaccaacaatgaattcaatataccaggaaatagattgttagtagggaatggcattaaaggaaaaaaaaattagataagatgcattcaaggaataattactttcactctgctggcttaatcagtgaaggaacataaaaggaaagctggcagtgggtcttggtaatatatgaactatattagagtgccagaaaaggagacctcagaagttaagcataggttgccaatctgctacaattatttttcccaccaatctgctcaaaatgattgtatatagtattcttaaaaccatgtgtcttggtgcagaaatattgacaaatgctggccagctttatcttcctatatccttcattaaaagtatatgcat

SEQ ID NO: 35470 - DNA, 3072 bp, Homo sapiens
atgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaag

SEQ ID NO: 35471 - DNA, 5046 bp, Homo sapiens
gggtgggatttcctccgccgccgccgccgccgccgccgcgggtcctgcgccgcgtccagcccgcccgcccgaccccggcccgaccccggccggccctgcccgcccggccccggggagggatgcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagagttattttgattctttccttgggcaaggccagggctattgctgcaggatcccgagttaggggagggcaggggccgggccccagaagagggagtggctgctgtctggtgtgcaggggtcggtgggttcctcaggggcatttctgccgacttgggctgagtcagaggcttgggaagagggggcggccgatggtctgtggctgggaagtgtgagggtctctcgccttgggtctgtgtcagttctggcagtgacagggtgtttgggggaaagacttgggtctgccgctacccacaggggactctcaggaacccgagagcttggggagatgaaatgggggtgcataggggccacctgttggctcagggccctgtgggggccgctgaacctgctggaactctcctgcctgccacatgccaggggcagggctgagggagtgtgagggatgcacagctgttcagggctgagacattctgggctggggctgtcccagcgtgggaggcgtgcgggctgtagggccccgaagctgacctccacctttctgcttctctctcacggacgccgcggcccgcagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatca

SEQ ID NO: 35472 - DNA, 3112 bp, Homo sapiens
atgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggggcggattggcacctgcacccgtggatgggggcggcgtggccagccttgggtgcctcctgggctgcacctgtgccaccttggccgcccggaggaccgcccaccactgcgggccccctggagccaggccgccggggcacccccacgcggggccatgtgccgcctgcacttggctgcctccagtcttttccccagcctctcggggccctagcaggatgacaagtaggcggctctggggcccaggacagcccagctggggacccaggaggtcagactgcagtggaccctggggcagggctgggggtgggctgggctctctgctccaccagccacagcttgacagattcccagcctgccagggcctgagaccctgtgtccacatgacctcagggagtcccccacctgctgcagggggtccagcaccccacaggggggcagtcccagagctgtggggaccggcacgacctttgcccagcctccctacccaaccaagcactttagactaagccacttcctcctcggggagcccaggcctccgtgggttgggctgggtggggggggggtctcaggttgcccctgaaggtctctgcactcctcctgcccttcccctgacacatgaacagatgccttaacttcctggagccaccagcctggtgagccattggcctctgcctgccaccaaggtcctgtggtcttggccagctccgcctgggccccactggggctgcctgcacccagagacgatgccggcgggatctcagagggcctgaggcccaagccctgtgtcctccagcagtggtacggcctgcggcagggtggcactccggccagcccttctccgtcacagggtccctgtccctgggtccaccctgggctgtggctctacatctcccatttggggacgagaaagccacaaaaccattctctattgttcttaagggtacccctgctaattaattccccaaataaaatttttggtgttgatc

SEQ ID NO: 35473 - DNA, 4569 bp, Homo sapiens
atttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccagaacttttcatctatttgaaggcgattaaactgtgtctaatgcaaacttcctgcctcctccttcccccttccatttcaagaatatgtttgtgtgtagggtgggggtgggggttggaaggggttgcttgttactccccaaacttccattaaccagggcacccttgggttggagaggtagttccaaactctccattgatctatactacattctgggctgaaggttttcttattctggactatgaagaaaggactttcaaggagatatagtgtgaacaggatcaggaaggtagagggattatatttacttaagagaacaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctatcaattcccatctcatacttcccagttaattggaattaatgaaatttggctgctcccagacctttttccatgtcttcctttttccttttaacaggatttaagttgagcattcttgagagagagagagagagagagattggaagagagatggggagagactgactcagatccctctcctgtctgcttctttttctggttctctcagttttttttcttgaagttataaagccaaacctggagaatttgtaagttgttaggtttccccaggtaacttggcactcatatgaaccccattttaataagtactcagcccatctcctctcctgggctcagatggctctctctcctccctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaaagggccttaaattgtttggtcttttcaatggctgacactgtctccaactctccccttcctccttcttcctcaagcttcctatgcaccctactttcccaggccaggatggttggcactgatcccaaacctctgggggcaggtggaaattggctgtggtgagccatttcttcatgtccattcagctctgaggccttcctggccctagctgagatcatcatctcctcctttgcttttaccccaggagtgaggttgggttagaggtggattctgattccgtagcagctaaattccattctccctgtcctgaccatcctgcctttacccataaagcacccgttcctactgaccaaatctctttactttgttggagaaaaaaagtattttgtttttaaatctattttctaatttaaatgcaatttaatatgtaaatctctgcacttttgtgtgagcctacaaatgtgtatgtgttgggggtttttcactctctggtatttcttaataaagaaatctttcttttggggggaagccaattaatgaaggagccttgaatggttttagaaatacagggctgtctgtttctttgtg

SEQ ID NO: 35474 - DNA, 2473 bp, Homo sapiens
ggcgtggcggagtcagggcgggcctcgagaggccgcgcccgcggctcggccccggactccggcctccggcctccggccccccgctggggagccggtcgctgcttcccgacggattttgatctttgttcttccaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaa

SEQ ID NO: 35475 - DNA, 737 bp, Homo sapiens
gacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctg

SEQ ID NO: 35476 - DNA, 581 bp, Homo sapiens
cccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtg

SEQ ID NO: 35477 - DNA, 1521 bp, Homo sapiens
gattggacgccggcgctgtcagccgcgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggagaaaaagacattcacgcttacaccagcctccgggggagccagcctgcctctgaaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgga

SEQ ID NO: 35478 - DNA, 1383 bp, Homo sapiens
gcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggagtgtcggagatgtatgcagtgtgacgccaagtttgactttctcaccagaaagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggagccaccttcctcgtcacgtttggaaactcagagaaacctgaaactatgacttgtcgtctttccaataaccagagatacttgtttctggatggagacagccactatgaaatcgaaattgtacacatttccaccgtgcagatcctcacagaaggcttccctcctggaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaaca

SEQ ID NO: 35479 - DNA, 9675 bp, Homo sapiens
actcggctcaaacatggctgcgctgagagctctattgctttgggcgccgggagcaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgagatgtgggcaggacatcaaccctcaaagagtagcctgggtctggcttcttgtactggagaaatggttggcccgggaaaagaagttactcccagttgttttccggagaaagcttgagtttcttttattgtcagaagacctccaaggtgacattccagagaacatcctcgaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcattgcgggctttgcagggccctgattcggtgccccctggggtagtcgatgccatctatggagccctgcggactctgcgttgccccgcagaaccacttggggttgagttgcatctcctgtgtgaggaactactagaggcctgcaggaccgaggggagtcccctgcgggaggagcggctgctcagctgcctgctgcacaaggccagccggggcctgctgtccctgtatggccatacctatgcagagaaggtcacagaaaagccaccgagggctacagcctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactctctctcctccccaggtgctgcaaatctcttctcaacttacctggccaggtgtcaacagtatctgtgcagtattcctgactctctgtgcctggagcttctggaaaacatcttctcattgcttctcatcacctctgctgatcttcacccagagcctcacttgcctgaggactatgctgaggatgatgacattgaggggaagagcccctcaggtttgaggtccccatcagagagccctcagcacatagcacatcctgaaaggaagtcagaacggggttccctgggagtcccaaagacccttgcttatacaatgccaagccatgtgaaggcagagccaaaagacagttacccagggcctcataggcacagctttttggacttaaaacactttactagtggtatcagtggatttctggctgatgaatttgcaataggggccttcctcaggcttctccaagagcaactggatgagatcagtagccgcagccctcctgagaagccaaagcaagaaagtcagagctgctcaggaagcagagatggactgcagagccgcctgcatcgactttccaaggttgtctctgaggcccagtggagacacaaggtggtgacaagcaaccatcgttcagaggagcaaccttcccgaagataccagcctgccacacgtcaccccagtctccgccggggtcgtcggacaagaaggagccaggcagatggccgagacagaggttcaaacccatccctggaaagtacaagtagtgagctgagcacaagtacgtcagagggaagtctgagtgccatgtctggccggaatgagctgcacagtagattgcacccccatcctcaaagttcactcatccccatgatgttctccccacctgagtcactgctggcatcctgcatccttcgcgggaacttcgcagaagcccatcaggtgctgttcacgttcaacctgaagtcctcacccagttcaggggaactgatgttcatggagcgctaccaggaagtgatccaagaactggcccaagtagagcacaagattgaaaaccagaactcagatgcgggtagcagcaccattcggagaactggcagtggccgctcaactctacaggccattggcagcgctgcagcagcaggaatggtgttttactctatctctgacgtgactgacaagctgctcaacacctctggagaccccatccccatgctccaggaggacttttggataagcacggctctagtggagcccactgctcccctgagagaggttctggaagacctcagtccccctgccatggctgcatttgacctagcttgctctcagtgccagctctggaaaacctgcaagcagcttttggagacagccgaacggcgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagaatgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgctcagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacgtatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgtt

SEQ ID NO: 35480 - DNA, 9612 bp, Homo sapiens
actcggctcaaacatggctgcgctgagagctctattgctttgggcgccgggagcaggaggtactccgcgaatgagaacattgagaatgtgttcggcataactcatttctttgtatctccctgcactctgtgctgggaaaatgaatcatccatttggaaaagaggaagctgcttcgcagaagcagctttttggatttttctgcgaatgcctgcggaggggagaatgggagctggcacaggcatgtgtacctcagctacaggagggacaaggggatatcccaaagagggtagaagacatacttcaggcattggtggtgtgtccaaatctgctgagatgtgggcaggacatcaaccctcaaagagtagcctgggtctggcttcttgtactggagaaatggttggcccgggaaaagaagttactcccagttgttttccggagaaagcttgagtttcttttattgtcagaagacctccaaggtgacattccagagaacatcctcgaggagctgtatgagaccttaacacagggtgcagtaggccacgtgcctgacggaaatccaaggagggagagctggactcctcgtctcagctccgaagctgtctctgtgctctgggatctcctgaggcagtctccccagccagcacaggccctgctggagctcctgcttgaggaggatgacggtactggcctctgtcactggcctctgcagaatgcactggtggacctcattcgaaaggcattgcggactctgcgttgccccgcagaaccacttggggttgagttgcatctcctgtgtgaggaactactagaggcctgcaggaccgaggggagtcccctgcgggaggagcggctgctcagctgcctgctgcacaaggccagccggggcctgctgtccctgtatggccatacctatgcagagaaggtcacagaaaagccaccgagggctacagcctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactctctctcctccccaggtgctgcaaatctcttctcaacttacctggccaggtgtcaacagtatctgtgcagtattcctgactctctgtgcctggagcttctggaaaacatcttctcattgcttctcatcacctctgctgatcttcacccagagcctcacttgcctgaggactatgctgaggatgatgacattgaggggaagagcccctcaggtttgaggtccccatcagagagccctcagcacatagcacatcctgaaaggaagtcagaacggggttccctgggagtcccaaagacccttgcttatacaatgccaagccatgtgaaggcagagccaaaagacagttacccagggcctcataggcacagctttttggacttaaaacactttactagtggtatcagtggatttctggctgatgaatttgcaataggggccttcctcaggcttctccaagagcaactggatgagatcagtagccgcagccctcctgagaagccaaagcaagaaagtcagagctgctcaggaagcagagatggactgcagagccgcctgcatcgactttccaaggttgtctctgaggcccagtggagacacaaggtggtgacaagcaaccatcgttcagaggagcaaccttcccgaagataccagcctgccacacgtcaccccagtctccgccggggtcgtcggacaagaaggagccaggcagatggccgagacagaggttcaaacccatccctggaaagtacaagtagtgagctgagcacaagtacgtcagagggaagtctgagtgccatgtctggccggaatgagctgcacagtagattgcacccccatcctcaaagttcactcatccccatgatgttctccccacctgagtcactgctggcatcctgcatccttcgcgggaacttcgcagaagcccatcaggtgctgttcacgttcaacctgaagtcctcacccagttcaggggaactgatgttcatggagcgctaccaggaagtgatccaagaactggcccaagtagagcacaagattgaaaaccagaactcagatgcgggtagcagcaccattcggagaactggcagtggccgctcaactctacaggccattggcagcgctgcagcagcaggaatggtgttttactctatctctgacgtgactgacaagctgctcaacacctctggagaccccatccccatgctccaggaggacttttggataagcacggctctagtggagcccactgctcccctgagagaggttctggaagacctcagtccccctgccatggctgcatttgacctagcttgctctcagtgccagctctggaaaacctgcaagcagcttttggagacagccgaacggcgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagaatgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttagacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgctcagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacgtatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgtt

SEQ ID NO: 35481 - DNA, 2927 bp, Homo sapiens
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 35482 - DNA, 2858 bp, Homo sapiens
gatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggagagtctctcttcccaggacctcacaccgggcagcgtggaggaggctgaggaggctgagccagatgaagagtttaaagatgcgattgaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 35483 - DNA, 2765 bp, Homo sapiens
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcagcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 35484 - DNA, 2997 bp, Homo sapiens
ggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 35485 - DNA, 2769 bp, Homo sapiens
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggagagtctctcttcccaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 35486 - DNA, 2669 bp, Homo sapiens
gcagagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtc

SEQ ID NO: 35487 - DNA, 3035 bp, Homo sapiens
agagcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 35488 - DNA, 2780 bp, Homo sapiens
ctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggagagtctctcttcccaggacctcacaccgggcagcgtggaggaggctgaggaggctgagccagatgaagagtttaaagatgcgattgaggagacccacttggtggtgctggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcgggaactgcacgggctgctcggccaccttctcagtgctgaagaagaggcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagagaggccagggtccaaccaggcacccgtccttgggaccagcagtagaccccccactctccccacccctggcccactgtggtgtgtgctgggcaaatgtggcctgaatgctaggtaggcttccccttccttcctcactctctccagctggattctggagctgttctccatccatgagagtggctggcaatggctgctctcaatcccttgagggagaagagcccctggagggcctggcatgtttgtcctgctctgcctgggactgagcgagtggacttagggctgggcaggcagtagccaccagagggcagcagcgaactaggccaggcctgactggggtctgaagatcagggtcagtgtggctgtgcctgggaattccagacctgaggttgggaaaagaggtttttctcctgcagggtactgggccaggccctcagcctcagagagcctgcagaagggcttgggagtgccacaccccatctctgctgattgaatgtccctccaggcaccaggatctcatcatttccccatcagagggtgtggccaggcctaacaagaccatgggtgcttctagaaacagggttgaagttcccagattccctgagaggagaatgtgtataggagggtttggctgagtccttcagcgttaagtggaggaaagcttggggaagccccaatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttc

SEQ ID NO: 35489 - DNA, 1504 bp, Homo sapiens
gcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagaggtcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcggtgtgacaggagcaggcagttcttaagggttcagagcagccagattccagcagtgcccggtaacactacacacaagaagtattactctggtccagcaaataatttgtctatttctacaacttctaagtaaagcggagctgcagtaattgtggaaacagcttctgctctcgatgctgctccttcaaggtgcccaagtcctccatgggggccacagcccctgaagcccagagggagactgtgtttgtgtgtgcctcgtgtaaccagaccttgagcaagtgagaagaga

SEQ ID NO: 35490 - DNA, 4131 bp, Homo sapiens
gtgcggcgcggggcggccgtgaccagcggagcgctgggtgtcagtgagcagcgaggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcgggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagcccctcggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtgaatctggaagccggagcaagggccactccacaggctctttggcacagcagggctccctatgtgcctcccaaacgtcaaatgcaggctacccattctccccatcagctgcccacctcgttccccagccctcacccctcacccctcaccatccttcctcaggacttggctaaacaacatgcatctcatttcttcttggagtggggagatgcgggaagctgacccagtggtcctctaggcaggcagggtgctcctggtgtctgcccaccactgtccccttgctgatggcatgggggtccgaccaggcactgacaccgcaggcagaggttgctcggggccttgggtcgggtttaccaatcagccaggacgcccggggccaccagctcagctaccacttccccttccctctgcaccctctggaaccctggcccaattcctcagaccccagagtggcctgggacccaagctgccgcagctgagtggccccagcggacacctcctcaggcttaaatctcaggcttcacattgcaatgacgattgcagttttatttttggagatgacacacctactgcttcttttctaggataaatctaattactgtttactggtggagtacatatgcatagaaacggcttctgtcggggggagagtatataatggaggaaatattatgtattgagattatatttattttctaaatgctgtaatttgaagccatttccataaatctatttaaggattgc

SEQ ID NO: 35491 - DNA, 3273 bp, Homo sapiens
ggagcgctgggtgtcagtgagcagcgaggagccgcgcgcccccgtgcccgcgtctgtccgtgcgcccgagcgcccactcccgggtctgaggtctgcccggcgcgccgcttgcagagcatactcagggccgcgcacctgccccgcgcacctgcccgccgcccgctcggcgctccgggcttcgctagccagcctccctgcgacagcgcgggggctccggccgtgcctccgcgtccgccccgcgcctcagccgggcccgggcgcagcgctgcggagggcgagggccgcccggagtccggccagggccggcgcggcgatgatgaacaggttccgaaagtggctctacaaacccaagaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcgggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagcccctcggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggacccggaggagcctggtggctgcctcagggcagggtgcctggcggagaaggcctgggccctcccactggtccctcggagatctgctggggctatgggaatcggggcgggtgatggaggtggacaagagtggggccactctgcgcctctgctgttgcggtg

SEQ ID NO: 35492 - DNA, 3247 bp, Homo sapiens
actctcgcgactttgccgcggcgacgtgggggttttatcgcggtatcgcggaacacagcccccgccattcccagtcacccgctcggaggccgtgggcgccttgacgagggcgcggcggcgggaatgcacaacgttatgctcatcacctgcgtccaccactgtcacccctgacggcgagacgcgaggtgctaagggcttgtccaggctaagcgggttctctgcgtccttaagcccactttgcagatgctaatcagaggggacaggcggccaagaacctggagcccacccgggcgtctgtgcccagtgccgaccgtctaaattcccttcccacgtggctcctgttgcgtctgggctgtggaggattcctctaaacaggcacagccaccctctggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatcatggatgagtgcatcccccaggaccgcgcccccagagatttctgcgtcaagttccctgaggagatccggcacgacaacctggccggccagctgtggttcggtgccgagtgcctggccgccggctccatcatcatgaaccgggagctggagagcatggccatgcgcccgctggccaaggagctgacgcgcagcctggaggacgtgcggggcgccctccgtgaccaggcgctgcgggacctgaacacctacacagagaagatgagggaagcgctgaggcacttcgacgtcctgttcgcagagtttgagctcagctacgtctcggccatggtgcctgtgaagtcccccagggagtactacgtgcagcaggaggtcatcgtgctcttctgcgagacggtggagagggccctggacttcgggtacctgactcaggacatgattgatgactacgagccggccctcatgttcagcatccccaggctggccatcgtgtgtggcctcgtggtctatgcggacggacctctgaacttggaccgcaaggtggaagacatgtccgagctgttccggcccttccacacgttgctgcggaaaataagggatttgctgcagacgctgacggaggaggagctgcacacgctggaacggaacctctgcatttcccaagacgtggagttccccatccgcgcagacgtgcagggacccgctgccctggcgcctgccctctctgcccctctcccccctgaggggccactctcagctaaggccaaagacccggatgcagagctggcctgctccatgcagtacgacgaccaggagctggagcagctcagccgcatggtccacagggcgggggacgagatgtcctctttgctttcaccgcccattgcctgccagtccccagctcacaggccaggagcggagggcagcccaggcggggaggcctctccaggtagaccgcgcctgcggtcaggcagtgacgaggaggagcgcgtgttcttcatggatgacgtggaggggacggcagaagccctggccaggcccgagtccccagctggcccatttgggtgggcaggcagtacctgggccgacccccaggagaaagggcagggtgggccaggcggagcggcggggatcagcttgcccgcctcggaaaaggaggaggacttgagcaacaacaatctcgaggccgagggcacagatggggccagcctcgcgggcaccagctcctgcagctgcctggactcgcggctgcacctggacggctgggaggtgggtgcggatgacgcagagacggctgagatgatcgcccaccggacagggggcatgaagctctcagccacggtcatcttcaaccccaaatcgcccacttccctggactctgcggtcgccacccaggaggccgcctcggagcccgtggccgaggggatggatggcggcccccacaagcttagcactggggccaccaactgccttctgcattcctgcgtgtgctgtgggagctgcggggacagcagggaggacgtggtggagcgtctgcgggagaagtgcagcccgggaggcgtcattggtgcctcgtacgctgccggcttagccaaggccagcgacagggcccctgagagacaggaggaggcgcccccaccctcagaagatgcctccaacgggcgggagcccaaagcccccacttccgacaagtgcctgcctcacacctcaggttcccaggtggacacagcgagtgggctgcaaggagaggctggggttgcaggtcagcaggagccagaggccagagagctgcatgctgggagcccctcggctcacgaggcgcctcaggccctgtcgggctccagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtggctgaccagctgcagacgaactatgccagtgacctgagaagtattcttaaaacactgtttgaggtcatggccaccaagcctgaaacagacgacaaggaaaagttaaggaaggtcacccagactctgcggagtgcggccttggaggactgtgcactgtgccaggagaccctgtcatcctctgaactggcagccaagacccgcgatggggactttgaagaccccccggagtgggtgccagacgaggcctgtggcttctgcacggcgtgcaaagcacccttcaccgtcatccgccggaagcaccactgccgcagctgtgggaagatcttctgctcgcgctgctcctcgcactcagcaccgctgccccgctacgggcaggtgaagccggtccgagtgtgcacccactgctacatgttccatgtcacgcccttctacagcgacaaggccggcctgtgacgtggtgccaggggcagccccaacccacccgggccaggaacccccaggaaggtggggccacgctgcaggcaggtctcactgcgtctcatgaggccgctgccgctgctgcaggggcacccagacctccagagcatccagagcctctgtcctgcccacgctagcctccctgcagggaccccgggccggctgcaggggccaacaagaggtcagctttgcccagcaggggaccc

SEQ ID NO: 35493 - DNA, 1296 bp, Homo sapiens
ctaccaccggcgtgcgttcgcaggtagatcgcggtgccagttgccatggagccggccgggccctgtggcttctgcccggcgggggaggtccagccagcgcgttacacctgccctcgctgtaatgcgccctactgctcgctgcgctgctaccggacgcatggcacctgcgcagaaaacttctaccgtgaccaggtgctgggagagctccgcggttgcagcgctcctcccagccgcctagcaagcgccctacgccggctgcgtcagcaacgcgagaccgaggacgagcctggggaagcaggcctcagctccggcccggcgcccggcggcctatcgggactctgggagcggctggcgccgggcgaaaaagctgccttcgagcggctgctgagccgcggtgaggccgggcggctgctgcctccatggcggccgtggtggtggaaccgcggagccggaccgcagcttctggaggagctggataatgccccgggtagtgacgccgcggagctggagctcgcccctgcgaggaccccgccggattctgtgaaagatgcctccgccgcggagcccgcggccgccgagcgggttcttggagatgtcccgggggcctgcacgcccgtcgtacccacccgcatccccgcgatagtcagcctgagccgcggcccagtctcgccgctcgtgcgcttccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggccctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtca

SEQ ID NO: 35494 - DNA, 951 bp, Homo sapiens
gcacgcgggcgcggctgcgtgagaggcgcgcggcggcgcagtaaacagtctccttccacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttaggggaatctgcaacattaagaagcttattgctcaatccacacctcaggcagttgatggtcaacctcgatcagggagaagacaaagcaaagctcatgagagcttacatgcaagagcctttgtttgtggagtttgcagactgctgtttaggaattgtggagccatcccagaatgaggagtcttaagatggattattgtgctgcttgctcaagcgtgtgcttgactcctggaacctgcctgctccctctcccagaccagctagtttggggctggggagctcaggcaaaagaggtttccaggatgcagattaggtcatgcaggcctttaccggcattgatgtggctcatgtttcaggcagacttggggtccttaaggtggcaagtcctttatggagagaaaacttgacattcagatgattgtttttaaatgttttacttttggtacagttgatagacatcataaacgatatcaagcttacacttcatatggagttaaacttggtcagtgttaataaaatcaaaacgtgattctactgtacattgcattattcataatttaattgtttgaaattacattaaataaatcaactaattaaatactaaa

SEQ ID NO: 35495 - DNA, 10199 bp, Homo sapiens
agcgcgcggagggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccccagccagaaccgggaccaagaatcgccttcagccctgtctggtgcatccttggcagaaagtgaggaggaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacatacttttggatttcccccttaataagccccttactcatgtttagagaagattttgaatttcatttattccattctactgtgttctgaggattatatcaatttagaagttgatgtccagaacaggttatctgtatcagttctgagaatagaaacaacctacagtgctgtcccaatttgtacttttttttctttactcggaagttagatgtcagagggacacctcaaataagtgactgtgatcccctgccttgtaatgaagtggaaaagagagggtccctaaaaatctgggcaagtggtgtcctaattagttactgagttaaaacaagttcatgaatttaggccttttgggaaagaaagagaatgtaagatttaacctgtaaatgttaagaatagaaccaaagagagggccacagaccattagttgttaagaggtatcaatcttaacagcatattttctcttgtgcaatgaaaagaacaatcgtagctcttttgggcatcttaggtcttttattctttctggatggcttacatcgaatccttgtgatttatttaaagacacatttttcctggagaggagaaagatcttctctaaaatagccttaacactgagaacatattaggcctaattttaaaagtccaattcagataactcctcagaagtaaatgcagcacactaaaattcattatcacaaaacttaatatttgttaatatgtttcctctgtgctaaaaggctgctgctaaccatggtagttagggaggaagagaaagtaaaagacattagtgttcaaaacttacatctttgggggtaaacaagacatatagtacatttaactcctagggaacttagaatatttatggtaggatagaaagagatgattgtggacacacacaagtaccccaaaaggccattatggtctagaataggtttcatagagaggattactaccacctgtgattatatggtatatgaaacatgagattttgtaacctggacattgcttttagctctgttggaaatggtcagtagagcaatttctgaatattttgatggtacggtgttgatggcatcagtccttttctgtggctttcagcccaacttaatacaagaggagttaaaaatagcacccaaaaggggtagctagagcaccctcaccatgcactaaagataaatctaaaaggtgttcaagtacattgaatcaagatgagtaatccaacttctatgttatgtaggatggatggagcacacaaattcttgcaaacattgtagaggtttttttaaacttcatccactaaggatttttttataataattacttttgaaaataaaatctcaactattttccaagttatgagtgtgctgctcttaaccctgtgagatgaaatcttcccatttggattacatatttgtagttctatatcgacatcagcagatggcaatagtatacaaatagtatacagcatgagccttccattgcttttatttctttgtttataagtatactataatccttcatctgaaacccttagggttttagaattcagaattttccccttttcagagagaatatatataatgtagattacataacaccctcaatggggcctggggcaacaccccataatcaaacattagtacattcatagtaactgggattaactatgtaaggcagtaagctacctgccttacatagtttaggtcaatttttgtcacaaacttatggaaaaactaggtttttagaaattttttggatctcagaattcgtgattagggattgctgacctctgtaaggaaactggtgtcaggtctagaattttccttctaatgaaatacgtagtcattttccccctttttaaattgcttagctttggtagaggtaactgaaggctttctttagaattcgtgtgttagattttaagaaaaatgcatgaaattgttaggacaggcataaatacaaatggcaattctagagccattacggaattttgaaacacttaacaattgctttcttttacttttcatcttgcctcaatacttgtagcattacaagtattccacgtaaataaacgtttatgaagagctgcagtcatgtcatggagccaggcatttattcattcaacaaataggttagtcttccacacacaatttcaggtgctgggaacacagaattaagacccagcccttcctctcaaggacttcgcgtagtttgggagaaacgggaatgggctggaatgtcagaataagatgggcacttaggccttattgagcatgatcacacttgtattttgaagtaaaataccctgatcaagtaatttaccaagaagctactttttgtgacacagctccgtctcctgaccgcggttccagacttcaccattacaccagtctattcccattctggaaagggagaggtatcagctcttagggggcagagattagcaaattgaaaaatagcagtgaaccagatggaaggctctcgatctttagaggttattaatcagtgtttgttcgttcaatttttaaccagtcaccttgctgttaagagcagaacataattggctggaatgtaatgtagggaatttttccctgttggatccctagcacctagaaaagttcctagcacctattaggtgttaataaatgattgttgaatgaatcagtgattacaagtacttttaagaattttgaaaataaaggaaccattggaaatacga

SEQ ID NO: 35496 - DNA, 5045 bp, Homo sapiens
cgaaggggggtgggccgggggaggggaggttcgttccgcggagccccagccagaaccgggaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggaggcaagtttgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggcgtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgt

SEQ ID NO: 35497 - DNA, 7417 bp, Homo sapiens
ccgccgcctcctccgcctcctcctcctcaccagcgctaaagccgggactggaccgagcggagttgaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggaggcaagtttgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggcgtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaatta

SEQ ID NO: 35498 - DNA, 1517 bp, Homo sapiens
tctatgaagacaaacagaatcctactaaaggagctctaaataaatcaagatgtacaatctgtggtaaactaactgaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatattacctggagaatacagcatctcattttaaatcattatgatcaatctctgataaaggcctagaatacaaattatgtcaaaagtgaaaaaatactatctcgaaaatttccttggggataagactactaaaattataatgcttcctctgagaaaatcatctctttgcatgtgatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagca

SEQ ID NO: 35499 - DNA, 10246 bp, Homo sapiens
agcgcgcggagggcggggcctccccgggctcggccgcgccgccgcctcctccgcctcctcctcctcaccagcgctaaagccgggactggaccgagcggagttgtgcgtgtcgccgaaggggggtgggccgggggaggggaggttcgttccgcggagccccagccagaaccgggaccaagaatcgccttcagccctgtctggtgcatccttggcagaaagtgaggaggaaaacacccccattgttagatgaggtcttaatcatggaacatttgaagtcacgtaaagaaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctgattcttggatctcccagtcagcttcatttccccgtaatcagaaacaaccaggggtggactctttatcaccagtggcctcacttcctaaacagattttccagccgtctgtccaacagcagcctactaaaccagttaaagtcacttgtgcaaactgcaaaaaacctttacagaagggccagacagcttatcaacgaaaaggatcagctcacctcttttgttctaccacctgcctttcttccttctcccacaagcctgctccaaagaaactctgtgttatgtgtaaaaaagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgagattcgccatgaagtcagctttaaaaatatgactcataagctgtgcagtgaccactgctttaatagatatagaatggccaatggtttaataatgaattgctgtgaacagtgtggagagtacttgcccagtaaaggtgctggaaataatgttctggtgattgatggtcaacagaaaagattttgctgtcaaagttgtgtcagtgaatacaaacaggtaggtagccatccaagcttcctgaaggaggttcgagatcacatgcaggactctttcttaatgcagcctgagaaatatggaaaactgacaacttgtactggttgccgaacacagtgcaggttttttgatatgactcagtgtataggtcctaatggatatatggagccatattgttcaactgcttgtatgaacagtcacaagacaaaatatgcaaaatcacaaagtttgggaattatttgccatttttgtaagcgaaactctttacctcaataccaagccacaatgcctgatggaaaactgtacaacttttgcaattccagttgtgtggctaaatttcaggctctaagtatgcagtcatctccaaatggccagtttgtagcgccaagtgatattcagttgaaatgcaactactgcaaaaattccttttgttcaaaaccagaaatcctggaatgggagaacaaagtgcatcagttctgcagcaaaacttgttcagatgactataagaagttgcattgcatagttacatattgcgaatactgtcaagaggagaagactcttcatgaaacagtaaatttctctggcgttaagagacctttctgtagtgaaggctgcaaattattatacaaacaggattttgccagacgtttaggattgagatgtgttacttgcaactattgttctcagctatgtaagaagggagcaactaaagaactcgatggtgttgtgagagatttctgcagtgaagattgctgtaaaaaatttcaggattggtactacaaggctgcaaggtgtgactgttgtaaatctcaaggaactcttaaagagcgagttcagtggcgtggggaaatgaaacatttctgtgatcaacattgcttactgcgtttctactgtcaacaaaatgagcccaacatgacaactcagaaaggacctgaaaacttacattatgatcagggttgtcagacatctcgaaccaaaatgacaggttcagcaccacccccttctccaacacctaacaaagagatgaagaacaaagcagttctttgcaaacctttaacaatgacaaaagctacttactgtaaacctcacatgcagaccaaatcttgtcagacagatgatacttggaggacagaatatgttccagtgcctatccctgtgcctgtgtatatcccagttcctatgcacatgtacagtcagaatattcctgttcctactacagttcctgttcctgtgccagttcctgtttttctgcctgctccattggacagcagtgagaagattcctgcagcaattgaggagctaaaaagcaaggtttcttcagatgctcttgatacagagttgcttacaatgacggatatgatgagtgaagacgaggggaaaacagagacaaccaacatcaacagtgtaattattgaaacagatataattggttcagaccttttgaagaactctgacccagagacacagtccagcatgcctgatgtaccatatgaaccagatttggatatcgaaatagattttcccagagctgctgaggagcttgatatggaaaatgaatttttattaccacctgtttttggcgaagaatatgaggaacagcccagacctcgatctaaaaaaaagggagccaagagaaaggctgtatcaggataccagtctcatgatgatagttctgacaattcagaatgcagctttcctttcaaatatacgtatggcgtaaatgcatggaaacactgggtcaaaactaggcaacttgatgaagatcttctggtattagatgagttaaaatcttctaaatcagtaaagttaaaagaggatctactctctcacaccacagctgagcttaactatgggttagctcattttgtcaatgagatccgacggccaaatggagagaattatgcacctgacagcatctattacctttgccttggaatacaggagtatttgtgtggaagtaatcgaaaagacaacatatttattgatcctggataccaaacatttgagcaagaattgaataaaatactgcgaagctggcaaccaagcatacttccagatgggtcaatattctctcgagttgaagaagactatctctggaggataaaacaactaggatcacactctccagtagctcttctgaatacactgttctactttaacactaagtattttggcctgaaaacagtggaacaacacttaagactttcctttggcactgtgtttaggcattggaaaaaaaatcctttaacgatggaaaacaaagcgtgtcttcgataccaagtgtcttccttgtgtggaacagataatgaagataaaattactactggaaaaagaaaacatgaagatgatgagccagtatttgaacaaattgaaaacacagccaatccttccagatgtcctgtgaaaatgtttgaatgctacttgtctaaaagtccacagaatcttaatcagaggatggatgttttttatttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacagatcatgctgcaatgttagctgtgtagtactctaaaacttagcaattttatcagaattcttgtgcctgtttacattggataaaattgtttttagaaattccactcctgaaatagttacagaaagtcaagctatgttaaataagataggatcacattttataatgaagattaccagtgtagtaattctgatattgcaaatgattgaggaacaaacaaagaaactaatagagaaagtcagtctcagaggaaatcccatttaatgttagattgtttggcttttgaaattacttcttatagaagattgcattaaaaaaaaaaacaactttgtgcttctgcatagcaatttatccattcagaccttttcttttagaataaggaaacttaaaatctactttctaaagactgaacaaagtgctagctgcaaattatcttgaaatcatttggctcttttctagcatgtgtgtaatcatgttttcttctgattcctgaatgaccatggtagcattagtgtttagaaattgttcaggggaaaattgagctattttccatagtggctagcaattgctacacatccttagatactcctctctcccataggataaatgttacagcacacaaaagaaattttctcaattctgatttggaaaatttcacaggtgtcattattgtatatctaagcaataattatctgaatgttttggcataaaaaattataatgttctaacttgttttataagttgaatgacttttcagtcccttgattttatattgttgagtgataatcagactgatagtagcaaatctgatcatacattactaaaatagattgctgattgtctatttaacgaagacaagtgggtaacatttaaaatatataatacaaaaattttctctaacttacctttttccagaactacttctttaagcacttttcctattaatgcctattgttgattaaaaggtggttaattctaaccatcttttagtcttcaaagtggtgctatattccatcaagagcaataaagtttttcccaggtgtcacttattgtatatgttaccaaataccatgaatttctgccatagtactactatcaagcaccttgtcttgctatttacagtttcttcatttgtatatttttagcttttctaagtggaaatgtctacataattttgatcttgacatgattgaggatttagagctcttgtctttgtcttgattgcaatccaacgatagattaacttgattctcagggggaaaagaaaaacttattttatgagaattgtttgttctgtgaaactcacttcacctagaacacatttcattgattcttggatcttagtttatgtggtcatagttgactgctgagaaaaggacaatgaaatgatagcaatttccttttgcttctaggtgatctctgattatagatagcatcctgtaaatataactttattgtcttgaaatgtttattgaagatgctatatttttctgttctgttttctgaagattttgccatttaaaatgatccagtgaaaaatatttatccacattgaagaaagtggatttcccatgcaaattgaatcttcattaacacattttaaaaggctttactgtattaggtaacatagatattaaaggatttttctaggcaagaagctcaactttttttttccataaaaataatttttgcttaaatagtaactcatggttttcttttattaaatggggttgttgtcagtatgttaaacattgaagtaggaggaggatgcatattgtactatgcattcaaatttatcactgttttttctgacagactttccctttgtcctttctagttatgacttgggaatggggtaacttctttatgcatagtattaagggttatagtatgaagaaatcataaaattgcaagttttggtttgcattactctaatgtgggttcatttaatctgagatcttaaatatcttgcagccttaaatcactacaaacatttgcatttttattatgccagttatttccaaaatgtattgttatacatgtcacttatgtttttaagctaatattgactgtaggataatctccttgttcccctcaaaatagtcatgaaagtgtacatgaaaatatttttaaagaataaatttctttaaattacatacttttggatttcccccttaataagccccttactcatgtttagagaagattttgaatttcatttattccattctactgtgttctgaggattatatcaatttagaagttgatgtccagaacaggttatctgtatcagttctgagaatagaaacaacctacagtgctgtcccaatttgtacttttttttctttactcggaagttagatgtcagagggacacctcaaataagtgactgtgatcccctgccttgtaatgaagtggaaaagagagggtccctaaaaatctgggcaagtggtgtcctaattagttactgagttaaaacaagttcatgaatttaggccttttgggaaagaaagagaatgtaagatttaacctgtaaatgttaagaatagaaccaaagagagggccacagaccattagttgttaagaggtatcaatcttaacagcatattttctcttgtgcaatgaaaagaacaatcgtagctcttttgggcatcttaggtcttttattctttctggatggcttacatcgaatccttgtgatttatttaaagacacatttttcctggagaggagaaagatcttctctaaaatagccttaacactgagaacatattaggcctaattttaaaagtccaattcagataactcctcagaagtaaatgcagcacactaaaattcattatcacaaaacttaatatttgttaatatgtttcctctgtgctaaaaggctgctgctaaccatggtagttagggaggaagagaaagtaaaagacattagtgttcaaaacttacatctttgggggtaaacaagacatatagtacatttaactcctagggaacttagaatatttatggtaggatagaaagagatgattgtggacacacacaagtaccccaaaaggccattatggtctagaataggtttcatagagaggattactaccacctgtgattatatggtatatgaaacatgagattttgtaacctggacattgcttttagctctgttggaaatggtcagtagagcaatttctgaatattttgatggtacggtgttgatggcatcagtccttttctgtggctttcagcccaacttaatacaagaggagttaaaaatagcacccaaaaggggtagctagagcaccctcaccatgcactaaagataaatctaaaaggtgttcaagtacattgaatcaagatgagtaatccaacttctatgttatgtaggatggatggagcacacaaattcttgcaaacattgtagaggtttttttaaacttcatccactaaggatttttttataataattacttttgaaaataaaatctcaactattttccaagttatgagtgtgctgctcttaaccctgtgagatgaaatcttcccatttggattacatatttgtagttctatatcgacatcagcagatggcaatagtatacaaatagtatacagcatgagccttccattgcttttatttctttgtttataagtatactataatccttcatctgaaacccttagggttttagaattcagaattttccccttttcagagagaatatatataatgtagattacataacaccctcaatggggcctggggcaacaccccataatcaaacattagtacattcatagtaactgggattaactatgtaaggcagtaagctacctgccttacatagtttaggtcaatttttgtcacaaacttatggaaaaactaggtttttagaaattttttggatctcagaattcgtgattagggattgctgacctctgtaaggaaactggtgtcaggtctagaattttccttctaatgaaatacgtagtcattttccccctttttaaattgcttagctttggtagaggtaactgaaggctttctttagaattcgtgtgttagattttaagaaaaatgcatgaaattgttaggacaggcataaatacaaatggcaattctagagccattacggaattttgaaacacttaacaattgctttcttttacttttcatcttgcctcaatacttgtagcattacaagtattccacgtaaataaacgtttatgaagagctgcagtcatgtcatggagccaggcatttattcattcaacaaataggttagtcttccacacacaatttcaggtgctgggaacacagaattaagacccagcccttcctctcaaggacttcgcgtagtttgggagaaacgggaatgggctggaatgtcagaataagatgggcacttaggccttattgagcatgatcacacttgtattttgaagtaaaataccctgatcaagtaatttaccaagaagctactttttgtgacacagctccgtctcctgaccgcggttccagacttcaccattacaccagtctattcccattctggaaagggagaggtatcagctcttagggggcagagattagcaaattgaaaaatagcagtgaaccagatggaaggctctcgatctttagaggttattaatcagtgtttgttcgttcaatttttaaccagtcaccttgctgttaagagcagaacataattggctggaatgtaatgtagggaatttttccctgttggatccctagcacctagaaaagttcctagcacctattaggtgttaataaatgattgttgaatgaatcagtgattacaagtacttttaagaattttgaaaataaaggaaccattggaaatacga

SEQ ID NO: 35500 - DNA, 5536 bp, Homo sapiens
aaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtc

SEQ ID NO: 35501 - DNA, 5593 bp, Homo sapiens
attgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtc

SEQ ID NO: 35502 - DNA, 1511 bp, Homo sapiens
gagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaaggg

SEQ ID NO: 35503 - DNA, 1841 bp, Homo sapiens
gggaaccatttgaatgagaggaggggatcacgggtagagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaa

SEQ ID NO: 35504 - DNA, 1867 bp, Homo sapiens
aaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaaggtggggccgagggagtagtgcattagagggctgtggaagggggtgtggttcttgggttataaataaaggtggctgatgggtcaagggctgggagaaataaaacaaataaagggggtttcaattgtatccgttatgttttatttttgaagctggctggtggatacacaggtctttgttacatcatcatctatactttttttgtatgcctgaaatatttcatgtttaaaacatttaaaaaataaaagtgaagggacaaatcc

SEQ ID NO: 35505 - DNA, 5253 bp, Homo sapiens
gacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaaggccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattg

SEQ ID NO: 35506 - DNA, 6021 bp, Homo sapiens
tccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacgggtacagaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattg

SEQ ID NO: 35507 - DNA, 6067 bp, Homo sapiens
gagagagagagagagagagagagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatcaagcagtaacggttactgcacaggcgttgccactgagccagagccatttaacccgacctgtgtggctggggatcaagcttcagataccccataactctgactctcagactgttttgggggccccgtggctgcagacaagggaaggaggggcacgtgagggctgggtccctgcctccccccgtcctccgctgtcactcactaccccaacagtcgcccagggggcgggacccggagaggtggggatgggggagggtaatcttggcaggcgcctgctgcatggcgtaggtagggactattgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccaggtaaggggagcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacaatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtc

SEQ ID NO: 35508 - DNA, 2268 bp, Homo sapiens
tctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttgtccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaacca

SEQ ID NO: 35509 - DNA, 2411 bp, Homo sapiens
accttcgaaaagtggtggcggctgcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagaagagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtgaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcgagagctggagagcttggtcccaaggctaggtgtgaagttagccaaaaccccaatgcggacatggggtccccggccaggcttcacctttgcttcccttcgtgctcgaacctgccatgtgtgtcacaggcacagctttgaagcgaagctgacaccttgcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacaccgcagaggtgaccagtgaaaccttcaacaaagaggccttcctggcctctcggggcctcactcgtggctattggacccagctcagcatgctgattccaggcccgggcttctccagacacccccgaggcaacacgccatccctcagccttcttcgcggtggagacccctaccagcttctccagggagacgggactgccctgatgcctcctgtgcccccacatccaccccggggtgtttttggctcatggcaggattactacacatggcggggcctcagcttggactcccccatagccgtgcttctcacctacccgctgaccgtgtactacgtcatcacccacctggtgccccagtccttccctgagctcaacatccaaaacaaacagtcactgaagatccacgtggtggaggccgggaaggagtttgaccttgtcatggtgttttgggagcttttggtcctgctcccccatgtggccctggagctgcagtttgtaggtgatggcctgccccccgaaagcgacgagcagcattttaccctgcagagggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggatttaactccgggtttgctctcaaggatacgtggctgaggtctctgccccggttacagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacatgaaaaggtaaataaaattacttgtttgaaacc

SEQ ID NO: 35510 - DNA, 1375 bp, Homo sapiens
cggtggcggtggcggcggcggcggcggcgcgtggcaggtccggcgggcgcgaggcggcggcggaggcccgagcccggcccagcctcgtcccgcccggagcccgcctggctgctaccccgaccccggctccggtcccgtcctgtcccggcgcgccgcggcctcgccccggcccccgctcggcgcctcccgagggagcggcgctgccggccgagagcgcaggcccggccatgaccgacttcaaattgggtatcgtgcggctcggccgggtggccgggaagaccaaatacacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtgggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatc

SEQ ID NO: 35511 - DNA, 5695 bp, Homo sapiens
gtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggggttgtagaaggtgatttagctgccatagaagcatacaagtcatcaggaggagacattgcacgtcagctcaccgcagatgaagtacgcttgctgaatcgtccttctgcctttgatgttggctatactcttgtacacttggctatacgttttcagaggcaggatatgctagcaatattgcttacagaggtgtctcaacaagcagcaaagtgtattccagcaatggtgtgtcctgaactgacagaacaaatccggagagagatagctgcctctcttcatcagagaaagggggattttgcttgctattttctgactgaccttgtaacatttacattgccagcagatattgaagatttgcccccaacagtccaagaaaaattatttgatgaggtgcttgatagagacgttcaaaaagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggttttacacacgctggaaagattgggaatcatggtattctcagagctttggtttacatttttccttgagagaagaacagtggcaagaagactgggcatttatactctctcttgctagtcagcctggagcaagcttggagcagacgcacatttttgtactggcacatattcttagacgaccaattatagtttatggagtaaaatattacaagagtttccggggagaaactttaggatatactcggtttcaaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctactttcaccttaaaagatccatctaagtctcagatctggaaacgttttgtaccgattatccacagcaaaacaaaaataagcttttattttattaataatttcgttcctcttgtgcccaatcaaatcttttaggaacaaactgcaagaaaagctaagaatgttttagagtgaactaaatacagacattgcttacttgttttgaagagggttttggttttggttattgtgtctttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaaaaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcgcgcgcgcgcacacacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctgactacttagcatctgtagtaatttctctatgtatagggataattttttagtgggcagagatcctgttctagttgcctgttaagcaaaatctgccctcccaattgaaaaagccaaagagaattgttagagggaaaagcatgtagccattgcagtctgcattgcagccagcgttgtccagagtacacgctcagcacttagcttctactgtgtgttgtggtctggtgagtgttgtttcccctgagcgctctattatttatttatttattatcaatcagtgaccctgaccacatagtgtgataggtgcagcattcttccctgtgggaaagaattaaagatggttccatttcctaggctacagacaggaatggggctctaaatggttttcatagactggctgttaaaggccaaaaattttggtaaatcaatgctatattatgctcttgaactattaaaacagccataattattgtcccaagatagaatatagtcctttttcaaagatgattatacgtggctaggtgacagacattaatgactgactctggagagtaagtcatacctgcactctgtggacttgatggttctttttctagagcaaacagagcgtggcattttgttttgacttgttcttccttggggtcaaatttatatatatatatataaatttttgtttgggcgaccaagatctaataattaaaacccaggtggaccatggattcagacctgcctttttatgtttttgactcttaggttcatcgtgtcccagacttcttcacatattcgtgaaggtaagatattctgtgtgcgcttggcctccttttcacgcatatttcattgcctctttgatgagtggttacgaagacgttaaactacctttttgttccctggggtaataggtcagtaactatgagcgccgtctctctccatgtgagcttgtgttaatagacacttttatggtagagttgggatggggccaccaccttaaaatgagtgagcagacaaggccaggcaagccaaaggctttaagacaccatgattttcttgttttgttttaattgggaagggaagtataaggaagagctcagagggagtttcatacctggaattgttggacttaattgacacttgcaaatacttttagtataaaggtttaattctatttaaaaagaagatccattaaatcaagctcttaactcatgggactatttgcaacacttctttgtaaatatcattttgtttgttaggttattggcaaaacagtttcaaggttcacttccctcccttgaaccaggtccaggtcattttgctttggggtagattaaagtcagaactctaaaagttgagcaactttgtttttttttgaattgatttagcactaacccaccattgcatcttaaggatggcatgacgtgataatgatggacttgtgtgaggttttgatttttcaattaaactttttgttatcacaggtaa

SEQ ID NO: 35512 - DNA, 5204 bp, Homo sapiens
ctacctctgggctttctattccgttccagagacccagtaccagaatatttaaatcactgtggcgttgaatacattttaatatctgatagggccagtttctgcgcattgcacatttttttttcccctttcaggaacgtgttcaggcccgcggcagggggcgggatcgcgcctcctcctcggctctggttccagccgagcctctcggacgcagagatggaaatcccgaagctgctcccggctcgcgggacactacagggcggcggcggcggcggtatccccgcgggtggcggccgagtccaccgaggccctgactcgccggctggccaggtccccacgcgccgcctcctgctgccccggggcccccaagatggcgggcccgggcggcggcgcgaggaggccagcacggcatcacggggccctggcccaagcctgttcgcgccgaggccccatcaacctagcggcggcggcgacgacttcttcctggtgctgcttgacccggtgggtggcgacgtggagaccgcgggctccggtcaggccgcagggcctgtgttgagggaggaggccaaggcgggcccggggctccagggggacgagagcggcgcgaaccccgcgggctgctctgcgcagggcccccactgcctgtccgcggttcccactccggccccgatctccgcccccggccccgccgcggccttcgcgggcacagtcactatccacaaccaggacctgctgttgcgctttgagaacggcgtcctcaccctggccacgcccccaccacacgcctgggagccaggggccgctcctgcccagcagcccaggtgtctgatcgccccccaagctgggttcccgcaagccgcgcacccgggtgactgcccagagctgcggtccgacctcctgctagccgagcccgcagaacccgcgcctgctccggcgccccaggaggaggcggagggcctggccgccgccctgggcccccgcggactgctgggctctggtccaggcgtggtgctgtacctgtgccccgaggcgctgtgcgggcaaaccttcgccaagaagcaccagctgaagatgcacctgctgacgcacagcagcagccagggccagaggcccttcaaatgccccctgggtggctgcggctggaccttcaccacctcttacaagctcaagaggcacctgcagtcgcacgataaactgcggcccttcggctgccctgcggagggctgtggcaagagcttcaccaccgtgtacaacctcaaggcgcacatgaagggccatgagcaggagaactcgttcaaatgtgaggtgtgcgaggagagcttccccacgcaggccaaactcggcgcccaccagcgcagccacttcgaacccgagaggccttaccagtgcgcgttttctggctgcaagaagacatttatcacagtgagtgctctgttttcccataaccgcgcccatttcagggaacaggaactgttttcctgctctttccctggctgcagcaagcaatatgacaaggcttgtaggctgaaaattcacctgcggagtcacaccggcgagagacctttcctttgtgactttgatggctgtggctggaacttcaccagcatgtccaaactcttaaggcacaaaaggaagcacgacgatgaccggaggttcatgtgccctgtggaaggctgtgggaaatctttcacgagggccgaacatctgaaaggccacagcattacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctcttacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatactctgactccttcgagcaccctttgtgaaaacagtgtctcagaactactgacaccagccaaagcggagtggagcgtacatcctaactctgacttctttggacaggagggagaaacccagtttggattccccaatgcagcaggaaaccatggttctcagaaagaaagaaatcttatcactgtgactggcagctcatttttggtatgaagcaactctattcattccttgccatgtggctaacttttattacagtcaattttgaggatattctggactaaatatttaagtgcagtcatttctttttggtttgcaaaaagagcacagccctggactatgagtttggagatctaaattctgatcttgagtctggaactgacaagttgtgtgaccctcagcaagtcacttaacctatctgagccttaatttccttatttataaattgtggtggtttgaacacattgctcataaggtcttttcagttttgttttgttttgttttgtgattttgtgctttttcttgaaaattttcgggcattttgcaattattattgtttgtacttgtaatcagaagcggtttgagccctgtagcactaaataatgaaagattgaggaactggtgttttacattaaaaatttaatggaaattttacacagtacgaaaatctaatgatagagctcaaaaaaaaagagctaaaaataggagttggttcttcttagctgtttatccttctaaccttttttttaaatgatgaaggtatgtttttgttgtggaaaatacaagggcttttgttatcactcagacccagagtgaaatgtttgctttgtggttttgaataagttggcctttaataagttatttagtctctcttagcctcagttttctatctgtaaaatggtcatagcaatgtgaacatatgtgttacatcctagacttatttttctaccccagtaggttgtattgaaaggaaaatgttatatgtgtttcagcatgttttggtgaatcttcattccctttcctgccccttgttttccctcctcaaaggggagaaattagcacaaattagtatcaggattgtgcaggaaataaacatttgtgaaggttaagaaagaggaaaaggaagttatttcttcaacagattaaggatttttctacacacagttcttttgtggcattggccacatgtccattagaccaatttgatagtatcttcggtctgcattcaaagccagctcatgcaatgagtattcagcctattcttccaagacaatctggacatagaccagagggagatttttctcccctctgtgccctagagagctcattgctggcttactcttagagttgaaatgagagggttttgtctgcattttgagtagataccatctatcttatgtgagtatagcattttacaatttagcactttcacaactattatatttgatcctcacaatcctgtgaggtaattatggcaaagtcagatctacaattcatattaaaatttacctagctcagattacaaatgtatttcacttagtaatgtgtgtgtgtgtgtgtgtgtgtgtgtgtgtgtagctcaaaacaaagaggaaatatttcccactctcccattcgactcttgagtttcatgactattttgtttataactgtttgctgcctcccaccttaattgatttctcttacattctttgtactccatgctatttccttgtaggtgtacaccagtccttgccatgaatctcttttacttacatttaaattagacacgtctctttcatggtcaccatctctcagccattcttcttatggcccatttttcagtcacagtattactgcaagtatgtgtgtacattgagaagtaattttctggatttagatggcaatgtgtttatacatgaatcagataataatggagacattttatataaggtgttagtgagaagtagttctacttttccttttttacagtgtggtcctggtagcaaacactattagttgctttcaactattgtaacccagtattgtttacatgtggatacttggggataacaattattatggcactttaacagtgcactttaatatataccaccttgatatacatctttactgtctttataatttttaagttggttgtacttattcaatgaaaaagcaaaaaatacacataaatttgtaattcaaagaaatagaattttgtgtctaaccatttaacagttctcccttagtattttagaaagattttaagccattttagaaatgtgttgtcattagttaagtcctcttaaatagattattattattttcctatagaaaatgcagaggcctgaggtgaacgcaagggtcataggcatccattaagatacataactatatagatatcttaaaactctgtcacattgtttccttaatcccttagacctatttcctcccatgaaaactatcataagctatgcttttgttatggtctatagaattttcaaaggacaaattttttttttttaggataaagatcttgtgattgtccgtgggctcacatggtttcttttgttcaattttttcaaaagatttctttttcaatactgttgtcccaccatgatagttgacatggcatgtaattacagacagaagtgtgactgtaaacatattagtgtttctgttagtgttggcataagcttgcctttttgtttaaacaatggaacatgatttaattttatctcatttgccttttgtttatcttcagtccttgatttattaacattttgccaattgaaaacacaataaaaaatgccttgcaggaa

SEQ ID NO: 35513 - DNA, 5638 bp, Homo sapiens
ctacctctgggctttctattctgttccagagacccagtaccagaatatttaaatcactgtggcgttaaatacgttttaatatctgatagggccagtttctgcgcattgcacatttttttttcccctttcaggaacgtgttcaggcccgcggcagggggcgggatcgcgcctcctcctcggctctggttccagccgagcctctcggacgcagagatggaaatcccgaagctgctcccggctcgcgggacactacagggcggcggcggcggcggtatccccgcgggtggcggccgagtccaccgaggccctgactcgccggctggccaggtccccacgcgccgcctcctgctgctccggggcccccaagatggcgggcccgggcggcggcgcgaggaggccagcacggcatcacggggccctggcccaagcctgttggcgccgaggaccgatcaacctagcggcggcggcggcggcggcggcgacgacttcttcctggtgctgcttgacccggtgggtggcgacgtggagaccgcgggctccggtcaggccgcagggcctgtgttgagggaggaggccgaggagggcccggggctccaggggggcgagagcggcgcgaatcccgcggggcccactgcgctaggcccccgctgcctgtccgcggttcccactccggccccgatctccgcccccggccccgccgcggccttcgcgggcacagtcactatccacaaccaggacctgctgttgcgctttgagaacggcgtcctcaccctggccacgcccccaccacacgcctgggagccaggggccgctcctgcccagcagcccgggtgtctgatcgccccgcaagctgggttcccgcatgccgcgcacccgggtgactgcccagagctgccgccagacctcctgctagctgagccggccgaacccgcgccagctccggcgcctgaggaggaggcggagggcccggccgccgccctgggcccccgcggaccgctgggctccggcccaggcgtggtgctgtacttgtgccccgaggcgcagtgcgggcaaaccttcgccaagaagcaccagctgaaggtgcacctgctgacgcacagcagcagccagggccagaggcccttcaaatgccccctgggtggctgcggctggaccttcaccacctcttacaagctcaagaggcacctgcagtcgcacgacaaactgcggccctttggctgcccggcagagggctgtggcaagagcttcaccacagtgtacaacctcaaggcgcacatgaagggccatgagcaggagaactcattcaaatgcgaggtgtgcgaggagagcttccccacgcaggccaaactcagcgcccaccagcgcagccacttcgaaccggagaggccttaccagtgcgcgttttctggctgcaagaagacatttatcacagtgagtgctctgttttcccataaccgcgcccatttcagggaacaggaactgttttcctgctcttttcctggctgcagcaaacaatatgacaaggcttgtaggctgaaaattcacctgcggagtcacaccggcgagagacctttcctttgtgactttgatggctgtggctggaacttcactagcatgtccaaactcttaaggcacaaaagaaagcacgacgatgaccggaggttcatgtgccctgtggaaggctgtgggaaatctttcacgagggcggaacatctgaaaggccacagcataacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctctcacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatgctctgactccttcgagcaccctttgtgaaaacagtgtctcagaactactgacaccaaccaaagcggagtggaacgtacatcctgactctgacttctttggacaggagggagaaacccagtttggattccccaatgcagcaggaaaccatggttctcagaaagaaacagatcttatcactgtgactggcagctcatttttggtatgaaccaactctattcattcctcatcatgtggcttacttttattacagtcaattttgaggatattctggactaaatatttaagtgcagtcatttctttttggtttgcaaaaagagcacagccctggactacaagtttggagatttaaattctgatcttgagtttggaactgacaagttgtgtgaccctgagcaagtcagttaacctatctgagccttaatttccttatttataaattgaggtggtttgaatagattgcttttaaggtctttctgctctgtgattccttgataatacatttctttccttgaaaaatatgaggacgtttttcagtgatgtggcatgcgtttttttttaactgcccccccagccctgacatgttctttttttggcaaacatacataatgttacatcatactatgatgaacatccatgtacttttcactcaatttcagcaattatgaatccatgaacaatcttttttaacttagcctcactcactccccatgttctagtattattttgtaacaaatagcagacatctgatcattttatccataaatattctttatatatctctgaaagctatgggatgatatggaaaaaaatgataattccattatcgcaagtgatatttacagtaattctttaatatcagtaaatatccagtgagggttcaaacttccaattgcctcataaatgctacttgttttattatttttaattagtagaatcccgtaaatctcctaagtgtcttcttaatccgtatgtttccctttcatctttctttttttccttgcgattttgtttatgaaatgaggttgtttcacatgtagcatttgccacaatttaagttttgctaattgcatccctatggtaatgtttgctttcctctatcctctgtttctttaatttgctagttatgtctagagacttgatgagattgaaacatggcttttggcatgaatgtttcataggttatgttgtgttcatttagtaggtggcgcataatctgtggttttctctctttttgtggtattagcagctgctgcagataaatgcattaattcatgatgcttctgatatgatgagtcatctttgtagagttactaagcattagcaaaggaggaaatgctatgtaatagaaatattattcaatgccaaaatattttcttaaatagtcatagaactaacaagaaaaaatagatagcaaaaaaatgtgttggctgttctcactgtttatcttcctaacttcttttgatgatggaaggcagttttgtggaaattgccagccaggactttgacatgaaacagacccagggctaaattttggctctgtggtgttggataagtggccttgaataaattagttattaagcttcagttttctagcttttaactgattataacaatgcacacacatacctgacacactgttaaattttcttctcttcctgtttcttatgttaaggaaagatactctgtgttttggcatatgttggtgaatttgtaccatttttatcctctcagtccttccttttataagacaataattggagtagtttaatcttattcatgtgcagataaaagaggtttatgaagtttagggtgaagtaggcaagggaatctgtttactccctcttccctctactgaataattttccctctactgaataattttccctctaagaattgctgtgggtaataccaggagtggggacattgcccacatgcataagagcgtatctctccattcgatcagtttgtcaccatctttgctctgttttgaaagtcaggcttctctgtgactgtgaagcctgctgttccctgaaaatctgataatggagcagtggaggtttttttctttctgtgctctgtagatctcattgtttgcacttgtaatttcccagagttgaaaggaaagattgaactggaatattgtgtaaactatctgtcttacattagtgtagcattttgcaatttggggaacatcttcacaatttgtgtctcgttgttcagaacaaccctgtgaagtagttttggcaatgtctgtgttacatttcatgtaatttagccaactcccattccaactaggctttggctaaatctgacaattttatatatagcttaaaacaaagaatatacattcttttcacccctcccagtctacccatccagccttcatgattcattcctgtgtcaaggttagtcgctgttttccatttgaattggtttcttttatggtcagtttactttcttccctctcccctccctttcctgcacatccccatccttgctatgcctttctgtcctcttttataatggatatatctttttcctgccattatccctcagacattctcctcatggcacattttcttcaaatgctaacatttactgagtgtacattgaagttctgtgcatacaggaagaagttattttctgagcttagataatactatgtgtatatgtgattaaaatgaagattattttctaaagccttcaaattagaagtggatttctgtttcattacttccgttttaaaagtttttgccagagagttttgctaaatactctcttatttgctctagtgtactagtccagtagtgtttgcatgtggatgtctgtggatgacagttattgtagcactttggcagtgcactaaaattttgccactatgaaatgtttctttattgtgtgtgcgtgtgtgttttgaaatacgcacacagccacacccacatatatattaaaagtggttgtattcatttagtgaaaaacaaaaagtagatgtacttctgtaaatcagataaatgcttggaatttgattgtctacccaatcaacagttttccctctttgctctggaaatatttgtactcatatagcatatttcaaaaatgttgtcattcattaaggcctcttaaatagaccactattttttgtgtctggcagatgagtatgtcaaggattgagatgaacacataagtcttggaaattaaataaatttataaacataaag

SEQ ID NO: 35514 - DNA, 5014 bp, Homo sapiens
acaggtcagagttgactccctgaaaagtgcagccggtttgaaatgcaagatggcggcggcgtggcgctgagaggcgcggcggcccctgcaggtagtggcgcgagccggctccgcgaccagcgggcccggagactctgggctgcgggtgggaactggagcgcagagtccgcggccggcacgggaaaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagttt

SEQ ID NO: 35515 - DNA, 4955 bp, Homo sapiens
gcgcggaggacgcgcgcgcgggagggccccgccttggccggctctctcccttccccctccgcccccggacggccgctggggcgcgcgcctctcctcgcacccccaccctgagtccccacactccgcggggccaccgagctgctgaggcccctttgcgggcccgccgagcggttccgggtttagggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatata

SEQ ID NO: 35516 - DNA, 3357 bp, Homo sapiens
aaaaaatcagacttccacttgaagcaattgcatcttttaggattaatgtggctcagcggagctctgctgtgcttttaggattactgtggctcagcggagctctgcacaaagggtccgcgactgggatgggggtggggagtgaacgtcaaggggcccaggagcgctcgagcgtccaaggcccggcgtgtggagcagctggagggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgc

SEQ ID NO: 35517 - DNA, 10030 bp, Homo sapiens
aaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaaatgaggaaactgagacacagcttaagaattttgcccaaagctacaaagattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagcttttttattttgggaggggaggagtgtcatttttgagaatcttgggttcctgaaaaagaacgccctagttggatggcttgccagggccttggggtttggtagtgattgtacaacttaaagctcctttctcttggctgagtgacaggtggctgttcaggtggaccaaagcaccttgacacaaggactccacactgtgctctctagtagcacaaggaggaagttggacagaacattgggtagtgccttgcgggctcacacatgtactagtggtctcatctccagctagccttgggaggccgtcccaccaggaaatctctctattccgtagcctgagatgtgcccttgtgggttttatcctgctcagtcagtggcctaggggcaggtcctgtgttctctccctctctctcctggctctgggacatctgtccctggctgcctttcatggaggaaggacactggcctttctggttggatgctgtgtggatgctctctgcttgagcctcgtggtctcttgtctctttttggaccaatatcctcagattggtgcagctttttcagttcagatatcacaccccaagtggataaaggcaacttgcaggagaggagagccagccaagaagaaaattttaaaaccaaacctcgtttaggattttcctaaagtcatcttctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttcaca

SEQ ID NO: 35518 - DNA, 657 bp, Homo sapiens
aaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatga

SEQ ID NO: 35519 - DNA, 3288 bp, Homo sapiens
gtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcggttcctggtcactgagttcccagcctctcccttccctccttaccctttga

SEQ ID NO: 35520 - DNA, 9991 bp, Homo sapiens
gtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagcttttttattttgggaggggaggagtgtcatttttgagaatcttgggttcctgaaaaagaacgccctagttggatggcttgccagggccttggggtttggtagtgattgtacaacttaaagctcctttctcttggctgagtgacaggtggctgttcaggtggaccaaagcaccttgacacaaggactccacactgtgctctctagtagcacaaggaggaagttggacagaacattgggtagtgccttgcgggctcacacatgtactagtggtctcatctccagctagccttgggaggccgtcccaccaggaaatctctctattccgtagcctgagatgtgcccttgtgggttttatcctgctcagtcagtggcctaggggcaggtcctgtgttctctccctctctctcctggctctgggacatctgtccctggctgcctttcatggaggaaggacactggcctttctggttggatgctgtgtggatgctctctgcttgagcctcgtggtctcttgtctctttttggaccaatatcctcagattggtgcagctttttcagttcagatatcacaccccaagtggataaaggcaacttgcaggagaggagagccagccaagaagaaaattttaaaaccaaacctcgtttaggattttcctaaagtcatcttctcttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttcac

SEQ ID NO: 35521 - DNA, 573 bp, Homo sapiens
ttctttccagctctggacaggaaaacatgaaaacagatgatcccaaggaggtttctccctaaactaacaattaaagaatatagttttactttttcatttttatttgttgaaactgaatccacaccaggaaaacccgaatggaagaacatcagaaaatagcacatccttgaagttacaaagcaacacatctgactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctg

SEQ ID NO: 35522 - DNA, 3551 bp, Homo sapiens
agcactaacattcttgtgtgctgaattgtgatagccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcag

SEQ ID NO: 35523 - DNA, 712 bp, Homo sapiens
agactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgc

SEQ ID NO: 35524 - DNA, 803 bp, Homo sapiens
aaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaagtaaggaaaaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgac

SEQ ID NO: 35525 - DNA, 688 bp, Homo sapiens
gccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaa

SEQ ID NO: 35526 - DNA, 9302 bp, Homo sapiens
agcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcacctgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagctactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttc

SEQ ID NO: 35527 - DNA, 3474 bp, Homo sapiens
ggaagttctttccagctctggacaggaaaacatgaaaacagatgatcccaaggaggactgaaatgcaactgcagaagcaacatgtgaccttttagagatgcttgtgggactgcataaagtgaagagggaaactggaaaaaaacaatgaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaaca

SEQ ID NO: 35528 - DNA, 1576 bp, Homo sapiens
aaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaaatgaggaaactgagacacagcttaagaattttgcccaaagctacaaagtgattctaacccatggaccaagaccctgccttggagattggggaacaggtgttggaagggctctattttggcaaagaatggattatttatgtgagcatatttccgcaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtca

SEQ ID NO: 35529 - DNA, 1528 bp, Homo sapiens
cgtagaaggcgcaaaagggggtggtagaggggaagcgggggcgttcgcgcaggcccgcctgaccgtgtgagagtgcatgcccgagtgtgcgttccgcgtgtgcacccgagagccgcctgcgtccacgcccgagggcccttgcactctgctgggatgtggcagcccatgcccccggtgtaaagagcgtcagctcgaccagtgaaggcggcagagccaggactcgaaccactcggggtacagtagcaccctgaatcttgggacccttgtctgcccacgcgaaaacactacacgtgggccccaggtcctcggattccctgagtggcgtattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggagaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtca

SEQ ID NO: 35530 - DNA, 6296 bp, Homo sapiens
cctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaagtaaggaaaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatgctctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttg

SEQ ID NO: 35531 - DNA, 4140 bp, Homo sapiens
agccgtcaaaggcagcaaatagactgaatgaaagatgagcttctgcctttatatccttctctcctgctacccaactcattgtggtgaaggaaaaagaaaacgcgggtggagactgcactatatgcttaggactgaaatgcaactgcagaagcaacatgtgaccttttagagatgcttgtgggactgcataaagtgaagagggaaactggaaaaaaacaatgaacatttatcaccatccagccactgtagataaatttgattggctgtctccctgccttcccttcacacccagtaccttccctgcctgaaatcctcattgagggcaagaactttatccccaggatctaaaccagtgctggacaatagatgctcatcccttccataggaaacagggaatgtttgtttctgtcttctggtaggagaaggattggtcccacccccagctccagggatggatcttgattgtttaagcccagtcagtgattctaacccatggaccaagaccctgccttggagattggggaacaggtgttggaagggctctattttggcaaagaatggattatttatgtgagcatatttccgcaaagctaatcccgaactcctggcctcaaatgatcttcctaccttggcttcccaaagtgctgggattacagacgtgagctgctgtgcctggccaagacttaattttgaatgacattgggactattgccaaaaatcaaatccatcttcatgttgtccacttctcagccttaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaaca

SEQ ID NO: 35532 - DNA, 6296 bp, Homo sapiens; identical to SEQ ID NO: 35530

SEQ ID NO: 35533 - DNA, 3108 bp, Homo sapiens
ctgtgacactgccagcagcgcgcagagggagggatgggggcgggtatcggcgtaggggccctcggaaagaacggatattgctgtgacaccgcggggacgctctgaagggacgagtgtcggtgtggcaccggtgcacgctgaaggagccggcggaaccgggtggccatggggatgtgggcatcgctggacgctttgtgggagatgccggccgagaagcgtatcttcggggccgtgctgctcttttcctggacagtgtatctttgggagaccttcctagcacagcggcagagaaggatatataaaacaacaactcatgtaccaccggagttaggacagatcatggattctgaaacatttgagaaatctcgactctatcaactggataaaagcactttcagcttctggtcaggactctattcagagactgaaggcactcttattcttctctttggaggaataccttatctctggagactttctggacggttctgtggttatgctggctttggaccagaatatgagatcactcagtccctggtgtttctgctgttggctacacttttcagtgcattgactggtttgccatggagtctttataatacttttgtgatagaagaaaaacatggcttcaatcaacagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggttcttgtcacaatctatgctgattatattgcccctttatttgacaaattcacacctctgcctgagggaaagcttaaagaagaaattgaagtaatggcaaagagtattgactttcctttgacgaaggtgtatgttgtggaaggatctaaacgctcttcccacagcaatgcttatttttatggcttcttcaagaacaagcgaatagttttgtttgacactctactagaagagtactctgtactaaacaaagacatccaggaggattctggcatggaaccccgcaatgaggaagaagggaacagtgaagaaataaaagctaaagttaaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactgagatgtccaggatctgtgactgaagacatttctgattatttctgtcctggcagcatgttccagctcttgatgtttttaaacttttttttagaagaaaaattaagtacagaaaagcccagatttaaatacatttaatatgtcattttaaaaatgattttaataattcatttcttaaaacactgaatgaattttgaagcttaatgtttttaaaggcatagttttatctttgacatctaatttaccatcaagttgtaaaattatttggaaaaatacagaactcgttttatttgtatacttatatggaatctgcatgtgaggtgtttgagggcatatgtttgaaagagggagcatcaccacaggaatcctttctgtgaggtggaaacagtggtcctgaatcattgtgctcacacctaacttgaaatctggtcttactttcatgctgttatgatttcacctggtgaatcagtgttttaaataagaaaggtaatagttggtaaggccaatgttatttaaatgaaagtagttagaaaaatgctctcctattctaccaaatttttaatttctttcttccctttcttgctacacagtgatcaagagtttctcatagtgctttgaagttagaaattatgtataggatattttaaatcattgagttttgtggggtttttttgtttgtttgtttcttttgttttttggaaaatccgtgtctttatctttttttcccacgtggtagatatgatcccattggaggtaaattgtagcttcttctcattcatgcagtaaataatacatcctttcactcagcagagatggccatattaaacacgttttgctatgttaaaagtggcagaacaggaaagacgaattaaaaataacattttttaagcgacataaggatgaaatactgatgaatctctgtgacattacagggaaaaaaatatagttttctatctctttcaagggcagaagagttttcatttttatttttgtaattttatctgtaagtcataaatattacttaatcaggcctgattctacttttgaaaattacagttcttgaaatgcagataatgtttactttgaaaacaaatgtcatgaatgatttccagtttttaaagctatatgtttcactgcttcatatctctgtccactttctgaatgagaacttattttgtgcctagagctctcactcactgataatgcttattaccttctgggcatttattccaaagtgggatcaactgtacgcctttggtatctgaccataaagtcttttgctccgctgacatttgggtgatgtcttcacatggaaatataataaaaataaaaatctagtttaatactgcattatttattttcctaaggctaaagaggagcagtcctatgcttttattcagcatcctttatctgtgacttcatgctctgataactgcctttccttccttctgtgcctttgaatacaaatttcagttctgcaaaagtgaaacattaaacattgccaacgcaaatgtatgta

SEQ ID NO: 35534 - DNA, 1429 bp, Homo sapiens
gccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagtccaatgcccgcgttttaccttattcaataagaagggcttcatttatggcaagacaggacagccagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacct

SEQ ID NO: 35535 - DNA, 2177 bp, Homo sapiens
gccgttgcgacggacgggtaggggaggcgaccccggcgttctgctccgcactgtggaggaggtggggaggtgttgggccagggctgaggtaggagggagtctgtccctcgacgcctcctgcgacgccagcccctgagcgatgatgcgaacgtgcgtcctactctccgcggtgctctggtgcctcacaggagacaaaatatatgtagagttacatcaaaatagtccagtccttatctgtatggattttaagctttctaaaaaagaaatagtggaccccacctacttatggattgggcctaatgaaaagacgttaacaggaaataatagaataaatataactgaaactggacagctgatggtgaaagattttttggagcctttgtctggactttacacatgtactctttcttataagactgttaaagcagaaactcaagaagaaaaaacagtcaaaaagagatatgactttatggtctttgcctatcgggaacctgattattcatatcagatggctgtacgttttaccacaaggtcttgtatagggagatacaatgatgtattctttagagtgctgaagaaaatcttggatagtctaatttctgatttgtcatgccatgtcatagagccatcatataaatgccattctgttgaaattccagaacatggcctcatacatgagctatttatagcatttcaagttaatccttttgcgccggggtggaaaggtgcttgcaatggatctgttgactgtgaagataccactaatcataatatcctccaggcaagagatcgaatagaagacttttttcggagccaagcatatattttctaccataactttaataaaactctaccagcaatgcattttgtggaccacagtttgcaagtagtacgtctggatagctgtcgaccaggctttggaaaaaatgaacgtctacacagtaattgcgctagctgttgtgtggtttgtagtcctgcgacttttagtcctgatgttaatgtaacttgtcagacctgcgtttccgtccttacctatggagctaaatcttgcccacaaacttcaaacaaaaatcagcaatatgaagattagaggtgaaagcattgttacttacttgtggaagtcggggacataagatgattttcacatcccagagcatcatagatagttccattaagtaaaatcagtaagaccaaaccactggaaaacatgcattttggaaactttaaaataaatggttaacatggcatttctaagaaggcatttaatccagtatctctagtgtacaaaggaaacttgaagttttaatggattatttttaatgaaatgttttattgtttacaaacggtatgttgctgtgtacctaagagtatagtaaggtcaagaagagtatcaaagtataataaaataaaaattgtatactctccatatatttatttgtttggaatcactcttgtgtgatataaaggcgtgtatattatctttgtattagaaccaaaaaagttatttattttggtccctatgattttattttttaagataaattaatatactgtattttttaaagtataggtttaggtttacagaataatagagcagataatatatagagttccatacacccactgcaccccataccctcattcctccttacacaatttctcctattattaagatggtgcattagtgtggcacatttgttacaaatgatgaaccaatattaatttattattaattatagcccatagttcacattaagattcattgtgttgtaaggttatgtgggttttgacaaattcataatggcatgtgtgcaccattgcagtctcatacagaatagtttcaccaccctcaaaatcctgtgcttcacttatttatccctcccgccgtgccctggcaaccactgatctttttactgtctctacagttttgccttttccaaaatgtcatgtagttggttggagttatgcagtatgtagactttttagactggcttctttcacttagcaatatgcatttaaggttcctccatgtctttttgtgacttgatagctcattttttattgctgaataatgttcattgtatggatatagcatagtatgtttatccattcgcccattaaaggaaatcttgattgcttccagttttcagtgattaaaaataaagccgctataaaca

SEQ ID NO: 35536 - DNA, 1954 bp, Homo sapiens
atggcaggaggctcagccacgacctggggttaccctgtggccctgctactgctggttgccaccctggggctgggtaggtggctccagcccgaccctggcctcccaggcctccggcacagctacgactgtgggatcaagggaatgcagctgctggtgttccccaggccaggccagactctccgcttcaaggtggtggatgaatttgggaaccgatttgatgtcaacaactgctccatctgctaccactgggtcacctccaggccgcaggagcctgcagtcttctcggccgattacagaggctgccacgtgctggagaaggatgggcgtttccacctgagggtgttcatggaggctgtgctgcccaatggtcgtgtggatgtggcacaagacgctactctgatctgtcccaaacctgacccctcccggactctggactcccagctggcaccacccgccatgttctctgtctcaaccccacaaaccctttccttcctccccacctctggccatacctcccaaggctctggccatgcctttcccagcccactggacccagggcacagctctgtccacccaacccctgctttaccatcccctggacctggacctaccctcgccaccctggctcaaccccactggggcaccttggaacactgggatgtgaacaaacgagattacataggtacccacctgagccaggagcagtgccaggtggcctcagggcacctcccctgcatcgtgagaagaacttcaaaagaagcctgtcagcaggctggctgctgctatgacaacaccagagaggttccctgttactatggcaacacagctactgtccagtgcttcagagatggctacttcgtcctcgtagtgtcccaagaaatggccttgacacacaggatcacactggccaacatccacctggcctatgcccccaccagctgctccccaacacagcacacggaagctttcgtggtcttctacttccctctcacccactgtggaaccacaatgcaggtggctggcgaccagctcatctatgagaactggctggtgtctggcatccacatccaaaaggggccacagggttccatcacgcgggacagcaccttccagcttcatgtgcgctgtgtcttcaacgccagtgacttcctgcccattcaggcatccattttcccacccccatcgcctgctcctatgacccagcccggccccctgcggcttgagctgcggattgccaaagacgagaccttcagctcgtactatggggaggatgactatcccatcgtgaggctgctccgagaaccagtccatgtggaggtccggcttctgcagaggacagaccccaacctggtcctgctgctgcaccagtgctggggcgctcccagtgccaaccccttccagcagccccagtggcccatcctgtcagacggatgccctttcaagggcgacagctacagaacccaaatggtagccttggacggggccacacctttccagtcgcactaccagcgattcactgttgctaccttcgccctcctggactcaggctcccagagagccctcagaggactggtttacttgttctgcagcacctctgcctgccacacctcagggctggagacttgctccactgcatgtagcactggcactacaagacagcgacgatcctcaggtcaccgtaatgacactgccaggccccaggacatcgtgagctctccggggccagtgggctttgaggattcttatgggcaggagcccacacttgggcccacagactccaatgggaactccagcctgagacctctcctttgggcggtccttttgctgccagctgttgccctggtccttgggtttggtgtctttgtgggcctgagccagacctgggcccagaagctctgggaaagcaacagacagtgaatgggcccaataaacaatcatttcaaacctactgaaa

SEQ ID NO: 35537 - DNA, 1569 bp, Homo sapiens
ggattctgaagcggaaggagagctgtctcctccagctggtggaaactgcttcctatcctcctcctggagagcccaactcccagagcagatggcagaggagacctttagatggggcggtcacatgtcccagctggccttataacaactgtcccagggaactattaatagatctaccttacacacatctggactttcagatctgaaacgccctggtttggatgacagattatatggtgaacctacttttagagtgtagttcaactcatttgtcacatggatgagaaaatcagtccataaagggtttgctggggccaacaccagcctaagtggagagtaagcgtccattctcctagaccggcacttaaagcctggctgtcacccagccatcccgtctctgtgctggatggacaccaaaccccaaggccctcatctgcctttgtcccagctactgtccagtgcttcagagatggctacttcgtcctcgtagtgtcccaagaaatggccttgacacacaggatcacactggccaacatccacctggcctatgcccccaccagctgctccccaacacagcacacggaagctttcgtggtcttctacttccctctcacccactgtggaaccacaatgcaggtggctggcgaccagctcatctatgagaactggctggtgtctggcatccacatccaaaaggggccacagggttccatcacgcgggacagcaccttccagcttcatgtgcgctgtgtcttcaacgccagtgacttcctgcccattcaggcatccattttcccacccccatcgcctgctcctatgacccagcccggccccctgcggcttgagctgcggattgccaaagacgagaccttcagctcgtactatggggaggatgactatcccatcgtgaggctgctccgagaaccagtccatgtggaggtccggcttctgcagaggacagaccccaacctggtcctgctgctgcaccagtgctggggcgctcccagtgccaaccccttccagcagccccagtggcccatcctgtcagacggatgccctttcaagggcgacagctacagaacccaaatggtagccttggacggggccacacctttccagtcgcactaccagcgattcactgttgctaccttcgccctcctggactcaggctcccagagagccctcagaggactggtttacttgttctgcagcacctctgcctgccacacctcagggctggagacttgctccactgcatgtagcactggcactacaagacagcgacgatcctcaggtcaccgtaatgacactgccaggccccaggacatcgtgagctctccggggccagtgggctttgaggattcttatgggcaggagcccacacttgggcccacagactccaatgggaactccagcctgagacctctcctttgggcggtccttttgctgccagctgttgccctggtccttgggtttggtgtctttgtggcctgagccagacctgggcccagaagctctgggaaagcaacagacagtgaatgggcccaataaacaatcatttcaaacctactg

SEQ ID NO: 35538 - DNA, 2268 bp, Homo sapiens
atggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcagaatgacagtgaagtgttcttatagcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaataa

SEQ ID NO: 35539 - DNA, 1483 bp, Homo sapiens
ctgcgcagagcgcgcccgcgtcctcgtggtggccgcagttgtgcacaccccagcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 35540 - DNA, 1348 bp, Homo sapiens
ccagcatcccacgggtataagatggccagaggcggctgcctgctgctctgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 35541 - DNA, 1284 bp, Homo sapiens
atggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcagcaaagacctttttggcaccgggaagctcatcagggctgctgacctcaccttgggcccagaggcctgtgagcctctggtctccatggacacagaagatgtggtcaggtttgaggttggactccacgagtgtggcaacagcatgcaggtaactgacgatgccctggtgtacagcaccttcctgctccatgacccccgccccgtgggaaacctgtccatcgtgaggactaaccgcgcagagattcccatcgagtgccgctaccccaggcagggcaatgtgagcagccaggccatcctgcccacctggttgcccttcaggaccacggtgttctcagaggagaagctgactttctctctgcgtctgatggaggagaactggaacgctgagaagaggtcccccaccttccacctgggagatgcagcccacctccaggcagaaatccacactggcagccacgtgccactgcggttgtttgtggaccactgcgtggccacaccgacaccagaccagaatgcctccccttatcacaccatcgtggacttccatggctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggctcggctgacatctgtcaatgctgtaacaaaggtgactgtggcactccaagccattccaggaggcagcctcatgtcatgagccagtggtccaggtctgcttcccgtaaccgcaggcatgtgacagaagaagcagatgtcaccgtggggactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagc

SEQ ID NO: 35542 - DNA, 1799 bp, Homo sapiens
gaattcccctttctgaaggcatcccacctgagtgtcacaaagatgtgcagctgaaaacaagcctgacttctgtatataaaggaatctgggcaggcagaccctcggctcttgggagaggaggcggagagtctgcagccggcaggaactcctggtagcattatgtggctgctgcggtgcgttttgctgtgtgtttcattatctcttgctgtgagtggccagcataagcctgaggcaccagattattccagtgtgctccactgtgggccgtggagcttccagtttgctgtaaacctcaaccaggaggcaacgtctcctcctgtactaatagcttgggacaaccaagggctgctgcacgagctgcagaatgactccgactgtggcacctggataagaaaaggtccaggcagctccgtggtgttggaggcaacctatagcagctgctatgtcactgagtgggactcccactacatcatgccagttggagttgaaggagcaggcgcggctgaacacaaggtggttacagagaggaagctgctcaagtgtcctatggatcttctagcccgagatgctccagatactgactggtgtgactccatcccagcacgggacagactgccatgtgcaccttcacccatctctcgaggagactgtgaagggctaggctgttgttatagctctgaagaggtgaattcctgctactatggaaacactgtgaccttgcattgtacccgagagggccatttctctattgctgtgtctcggaacgtgacctcgccaccactgctcttggattctgtgcgcttggcccttaggaatgacagtgcgtgtaaccctgtgatggcaacacaagcttttgttctgttccagtttccatttacttcctgtggcaccacaagacagatcactggagaccgagcagtatatgaaaatgaactggtggcaactagggatgtgaaaaatgggagccgtggctctgtcactcgtgacagcatcttcaggctccatgtcagctgcagctactcagtaagtagcaactctctcccaatcaatgtccaggttttcactctcccaccaccctttcctgagacccagcctggacccctcactctggaacttcagattgccaaagataaaaactatggctcttactacggtgttggtgactacccagtggtgaagttgcttcgggatcccatttacgtggaggtctccatccttcacagaacagacccctacctggggctgctcctacaacagtgttgggcaacacccagcactgaccccctgagtcagccacagtggcccatcctggtaaagggctgcccctacattggagacaactatcagacccagctgatccctgtccagaaagccttggatcttccatttccctctcaccaccagcgcttcagcatcttcaccttcagctttgtgaaccctacagtggagaaacaggccctcaggggaccggtgcatctgcactgcagcgtgtcagtctgccagcctgctgagacaccatcctgtgtggtgacctgtcctgatctcagtcgaagaagaaattttgacaacagttctcagaacactactgctagtgtttctagcaaaggccccatgattctactccaagccactaaggaccctccagaaaagctccgtgttcctgtagactcgaaagttctgtgggtggcaggcctttctgggaccttaatccttggagccttgttagtatcctacttggctgtcaagaaacagaagagttgcccagaccaaatgtgtcaataaaaccagagtgtattccc

SEQ ID NO: 35543 - DNA, 2992 bp, Homo sapiens
agtgcgcccctcgccttccgggcggcggtctgaggcccgcgagactccgtttcccggcaggcctcgcgtcaagacggccggcgggacgggagctgcggcgctggctacgagagtgacccagtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaa

SEQ ID NO: 35544 - DNA, 2735 bp, Homo sapiens
gtcagcgttggttcccgtcttggccatggcctcgttcgtgacagaagttttggcacactccgggaggctggaaaaggaggatctggggacccggatcagccgcctgacccggcgggtggaggagatcaagggtgaggtgtgcaatatgattagcaagaagtacagtgaattcctgcctagcatgcagagcgcgcagggcctgattacccaggtggataagctatctgaagacattgacctgctgaaatccaggatagagagtgaggtccgccgggatcttcacgtatcaaccggtgaatttacagacttaaagcagcagttggaaagagactcagttgtcctaagtttgcttaaacagttgcaggagttttccactgctattgaagaatataattgtgcattaacagagaagaagtatgtcactggtgctcagcgtctggaagaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtcagatgctgctgaagtatatccttaggccgctggcatcttgcccatcccttcatgctgtgatagaaagccagcctaacatagttattattcgttttgaatctataatgactaacttggaatatccatcaccatctgaagtttttacaaagatcagactggtactagaagtgctccagaaacagcttctagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatgtgctgttcaacttttctactcagtgaggaatatcttccatttgttccatgatgttgtaccaacatatcacaaggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttgggacagaatgctttttggcccaaatgcgggcacagaaaggtgaacttctggaaagattatcaagtgctaggaacttttcaaatatggacgatgaagagaattattctgcagcaagtaaagcagtccggcaggtactgcaccaactaaagagacttggaattgtgtggcaggatgtcctgccagtgaatatatattgcaaggctatggggactttactcaatacagcaatttctgaggtcattggcaaaattactgccctagagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggagggga

SEQ ID NO: 35545 - DNA, 3183 bp, Homo sapiens
agtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattcaaagaaacaaa

SEQ ID NO: 35546 - DNA, 3267 bp, Homo sapiens
agtcgaggtatcttctccccaaccactgctcttattttaattattgcagacggaagttgaagactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattc

SEQ ID NO: 35547 - DNA, 1839 bp, Homo sapiens
acattggggcgggatgtgggagcggctgaactgcgcagcagaggacttttattctcgtctccttcagctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaa

SEQ ID NO: 35548 - DNA, 1460 bp, Homo sapiens
gcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctgcgacgtggcggtgcaggtgagcccgcgcatcgacgccgcggtacagtgctcgctggggaggcgcacgctgcagcgccgggcccgcgaccccgagtccccggccggccccggggccgagggcaccacgggtggcggctctttctcccagcagccatcccgtcgaggcctggagcagggcagcccccagaacggcgccccgcggcccatgcgcttcccgcgcaccgtcgccgtgtactcgcccctggccttgcgccgtctcaccgccttcctggaggggcccgggcccgcggcgggcgagcagaggtccggggcgtcggacggagagagggggccgccgcccgcgcggcttcaaggcccagaggagggggaggtgtggacgaagaaggcgccccggcggccgcagtccgacgacgacggcgaggcccaggccgcagtccgagcgagctgggagcagccggccgacggtcccgagctgccgccgcgagaggcccaggagggcgaggcggctccgcggtcggcgctaaggagcccggggcaacctccgtcggcggggagggcccgagacggcggcgacggacgggaggcggccgtcgcgggagaggggccgtcgccacggagcccggagctgggcaaggagcggctgcgcttccagttcttagagcagaaatatggctattaccactgcaaggactgcaacatccgctgggagagtgcttatgtgtggtgtgtacagggaactaacaaggtttacttcaaacagttttgcagaacttgtcagaagtcttataacccttaccgagtggaggatatcacctgtcaaagttgtaaacaaacgagatgttcctgcccagtaaaacttcgccacgtggaccctaaacggccccaccgtcaagatttgtgcggtagatgcaaaggcaaacgcctgtcctgtgacagcactttcagcttcaaatacatcatttaggtgaaagtcagtgttgctgtgcatgcgctgatggagtagacgagtgagcttttccgtgcctctcctccacctctcccttctcaaaatacttcatgaaaggcagtgtattctgaaaaagccttcaaataaaggtattgcaacacga

SEQ ID NO: 35549 - DNA, 2493 bp, Homo sapiens
ctgagccgggctggggcggcgggggcggcagtgagtggggtgggggcgagcggacctcggcggagcctccggcctgaggcaggatcagggccccttcctgggggagtttcctgcctggtccgcccttccccgctctccccgccccctctccgggccgctccttgtatggtctgggcgccgctctctccccgccccctctcttctccctccctcctccttccgtgtgtccctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaa

SEQ ID NO: 35550 - DNA, 2050 bp, Homo sapiens
gcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 35551 - DNA, 2123 bp, Homo sapiens
agatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctgactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 35552 - DNA, 2050 bp, Homo sapiens; identical to SEQ ID NO: 35550

SEQ ID NO: 35553 - DNA, 703 bp, Homo sapiens
cggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttc

SEQ ID NO: 35554 - DNA, 2445 bp, Artificial Sequence
  Description of Artificial Sequence: Synthetic coding sequence
atgcccaccgtgatcagcgccagcgtggccccccgcaccgccgccgagccccgcagccccggccccgtgccccaccccgcccagagcaaggccaccgaggccggcggcggcaaccccagcggcatctacagcgccatcatcagccgcaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagcgcccccccgagatctgcgagaacccccgcttcatcatcgacggcgccaaccgcaccgacatctgccagggcgagctgggcgactgctggttcctggccgccatcgcctgcctgaccctgaaccagcacctgctgttccgcgtgatcccccacgaccagagcttcatcgagaactacgccggcatcttccacttccagttctggcgctacggcgagtgggtggacgtggtgatcgacgactgcctgcccacctacaacaaccagctggtgttcaccaagagcaaccaccgcaacgagttctggagcgccctgctggagaaggcctacgccaagctgcacggcagctacgaggccctgaagggcggcaacaccaccgaggccatggaggacttcaccggcggcgtggccgagttcttcgagatccgcgacgcccccagcgacatgtacaagatcatgaagaaggccatcgagcgcggcagcctgatgggctgcagcatcgacgacggcaccaacatgacctacggcaccagccccagcggcctgaacatgggcgagctgatcgcccgcatggtgcgcaacatggacaacagcctgctgcaggacagcgacctggacccccgcggcagcgacgagcgccccacccgcaccatcatccccgtgcagtacgagacccgcatggcctgcggcctggtgcgcggccacgcctacagcgtgaccggcctggacgaggtgcccttcaagggcgagaaggtgaagctggtgcgcctgcgcaacccctggggccaggtggagtggaacggcagctggagcgaccgctggaaggactggagcttcgtggacaaggacgagaaggcccgcctgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggccgctgggtgcgcggctgcagcgccggcggctgccgcaacttccccgacaccttctggaccaacccccagtaccgcctgaagctgctggaggaggacgacgaccccgacgacagcgaggtgatctgcagcttcctggtggccctgatgcagaagaaccgccgcaaggaccgcaagctgggcgccagcctgttcaccatcggcttcgccatctacgaggtgccccaccagatgcacggcaacaagcagcacctgcagaaggacttcttcctgtacaacgccagcaaggcccgcagcaagacctacatcaacatgcgcgaggtgagccagcgcttccgcctgccccccagcgagtacgtgatcgtgcccagcacctacgagccccaccaggagggcgagttcatcctgcgcgtgttcagcgagaagcgcaacctgagcgaggaggtggagaacaccatcagcgtggaccgccccgtgcccatcatcttcgtgagcgaccgcgccaacagcaacaaggagctgggcgtggaccaggagagcgaggagggcaagggcaagaccagccccgacaagcagaagcagagcccccagccccagcccggcagcagcgaccaggagagcgaggagcagcagcagttccgcaacatcttcaagcagatcgccggcgacgacatggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35555 - DNA, 468 bp, Artificial Sequence
  Description of Artificial Sequence: Synthetic coding sequence
atggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35556 - DNA, 2187 bp, Artificial Sequence
  Description of Artificial Sequence: Synthetic coding sequence
atgcccaccgtgatcagcgccagcgtggccccccgcaccgccgccgagccccgcagccccggccccgtgccccaccccgcccagagcaaggccaccgaggccggcggcggcaaccccagcggcatctacagcgccatcatcagccgcaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagcgcccccccgagatctgcgagaacccccgcttcatcatcgacggcgccaaccgcaccgacatctgccagggcgagctgggcgactgctggttcctggccgccatcgcctgcctgaccctgaaccagcacctgctgttccgcgtgatcccccacgaccagagcttcatcgagaactacgccggcatcttccacttccagttctggcgctacggcgagtgggtggacgtggtgatcgacgactgcctgcccacctacaacaaccagctggtgttcaccaagagcaaccaccgcaacgagttctggagcgccctgctggagaaggcctacgccaagctgcacggcagctacgaggccctgaagggcggcaacaccaccgaggccatggaggacttcaccggcggcgtggccgagttcttcgagatccgcgacgcccccagcgacatgtacaagatcatgaagaaggccatcgagcgcggcagcctgatgggctgcagcatcgacaccatcatccccgtgcagtacgagacccgcatggcctgcggcctggtgcgcggccacgcctacagcgtgaccggcctggacgaggtgcccttcaagggcgagaaggtgaagctggtgcgcctgcgcaacccctggggccaggtggagtggaacggcagctggagcgaccgctggaaggactggagcttcgtggacaaggacgagaaggcccgcctgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggccgctgggtgcgcggctgcagcgccggcggctgccgcaacttccccgacaccttctggaccaacccccagtaccgcctgaagctgctggaggaggacgacgaccccgacgacagcgaggtgatctgcagcttcctggtggccctgatgcagaagaaccgccgcaaggaccgcaagctgggcgccagcctgttcaccatcggcttcgccatctacgaggtgcccaaggagatgcacggcaacaagcagcacctgcagaaggacttcttcctgtacaacgccagcaaggcccgcagcaagacctacatcaacatgcgcgaggtgagccagcgcttccgcctgccccccagcgagtacgtgatcgtgcccagcacctacgagccccaccaggagggcgagttcatcctgcgcgtgttcagcgagaagcgcaacctgagcgaggaggtggagaacaccatcagcgtggaccgccccgtgccccagcccggcagcagcgaccaggagagcgaggagcagcagcagttccgcaacatcttcaagcagatcgccggcgacgacatggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35557 - DNA, 2184 bp, Artificial Sequence
  Description of Artificial Sequence: Synthetic coding sequence
atgagctggcagatcagcctgaagacccagaccacccagcagaagaacgagatctgcgagaacccccgcttcatcatcgacggcgccaaccgcaccgacatctgccagggcgagctgggcgactgctggttcctggccgccatcgcctgcctgaccctgaaccagcacctgctgttccgcgtgatcccccacgaccagagcttcatcgagaactacgccggcatcttccacttccagttctggcgctacggcgagtgggtggacgtggtgatcgacgactgcctgcccacctacaacaaccagctggtgttcaccaagagcaaccaccgcaacgagttctggagcgccctgctggagaaggcctacgccaagctgcacggcagctacgaggccctgaagggcggcaacaccaccgaggccatggaggacttcaccggcggcgtggccgagttcttcgagatccgcgacgcccccagcgacatgtacaagatcatgaagaaggccatcgagcgcggcagcctgatgggctgcagcatcgacgacggcaccaacatgacctacggcaccagccccagcggcctgaacatgggcgagctgatcgcccgcatggtgcgcaacatggacaacagcctgctgcaggacagcgacctggacccccgcggcagcgacgagcgccccacccgcaccatcatccccgtgcagtacgagacccgcatggcctgcggcctggtgcgcggccacgcctacagcgtgaccggcctggacgaggtgcccttcaagggcgagaaggtgaagctggtgcgcctgcgcaacccctggggccaggtggagtggaacggcagctggagcgaccgctggaaggactggagcttcgtggacaaggacgagaaggcccgcctgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggccgctgggtgcgcggctgcagcgccggcggctgccgcaacttccccgacaccttctggaccaacccccagtaccgcctgaagctgctggaggaggacgacgaccccgacgacagcgaggtgatctgcagcttcctggtggccctgatgcagaagaaccgccgcaaggaccgcaagctgggcgccagcctgttcaccatcggcttcgccatctacgaggtgcccaaggagatgcacggcaacaagcagcacctgcagaaggacttcttcctgtacaacgccagcaaggcccgcagcaagacctacatcaacatgcgcgaggtgagccagcgcttccgcctgccccccagcgagtacgtgatcgtgcccagcacctacgagccccaccaggagggcgagttcatcctgcgcgtgttcagcgagaagcgcaacctgagcgaggaggtggagaacaccatcagcgtggaccgccccgtgcccatcatcttcgtgagcgaccgcgccaacagcaacaaggagctgggcgtggaccaggagagcgaggagggcaagggcaagaccagccccgacaagcagaagcagagcccccagccccagcccggcagcagcgaccaggagagcgaggagcagcagcagttccgcaacatcttcaagcagatcgccggcgacgacatggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35558 - DNA, 2445 bp, Artificial Sequence
  Description of Artificial Sequence: Synthetic coding sequence
atgcccaccgtgatcagcgccagcgtggccccccgcaccgccgccgagccccgcagccccggccccgtgccccaccccgcccagagcaaggccaccgaggccggcggcggcaaccccagcggcatctacagcgccatcatcagccgcaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagcgcccccccgagatctgcgagaacccccgcttcatcatcgacggcgccaaccgcaccgacatctgccagggcgagctgggcgactgctggttcctggccgccatcgcctgcctgaccctgaaccagcacctgctgttccgcgtgatcccccacgaccagagcttcatcgagaactacgccggcatcttccacttccagttctggcgctacggcgagtgggtggacgtggtgatcgacgactgcctgcccacctacaacaaccagctggtgttcaccaagagcaaccaccgcaacgagttctggagcgccctgctggagaaggcctacgccaagctgcacggcagctacgaggccctgaagggcggcaacaccaccgaggccatggaggacttcaccggcggcgtggccgagttcttcgagatccgcgacgcccccagcgacatgtacaagatcatgaagaaggccatcgagcgcggcagcctgatgggctgcagcatcgacgacggcaccaacatgacctacggcaccagccccagcggcctgaacatgggcgagctgatcgcccgcatggtgcgcaacatggacaacagcctgctgcaggacagcgacctggacccccgcggcagcgacgagcgccccacccgcaccatcatccccgtgcagtacgagacccgcatggcctgcggcctggtgcgcggccacgcctacagcgtgaccggcctggacgaggtgcccttcaagggcgagaaggtgaagctggtgcgcctgcgcaacccctggggccaggtggagtggaacggcagctggagcgaccgctggaaggactggagcttcgtggacaaggacgagaaggcccgcctgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggccgctgggtgcgcggctgcagcgccggcggctgccgcaacttccccgacaccttctggaccaacccccagtaccgcctgaagctgctggaggaggacgacgaccccgacgacagcgaggtgatctgcagcttcctggtggccctgatgcagaagaaccgccgcaaggaccgcaagctgggcgccagcctgttcaccatcggcttcgccatctacgaggtgcccaaggagatgcacggcaacaagcagcacctgcagaaggacttcttcctgtacaacgccagcaaggcccgcagcaagacctacatcaacatgcgcgaggtgagccagcgcttccgcctgccccccagcgagtacgtgatcgtgcccagcacctacgagccccaccaggagggcgagttcatcctgcgcgtgttcagcgagaagcgcaacctgagcgaggaggtggagaacaccatcagcgtggaccgccccgtgcccatcatcttcgtgagcgaccgcgccaacagcaacaaggagctgggcgtggaccaggagagcgaggagggcaagggcaagaccagccccgacaagcagaagcagagcccccagccccagcccggcagcagcgaccaggagagcgaggagcagcagcagttccgcaacatcttcaagcagatcgccggcgacgacatggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35559 - DNA, 2463 bp, Artificial Sequence
  Description of Artificial Sequence: Synthetic coding sequence
atgcccaccgtgatcagcgccagcgtggccccccgcaccgccgccgagccccgcagccccggccccgtgccccaccccgcccagagcaaggccaccgaggccggcggcggcaaccccagcggcatctacagcgccatcatcagccgcaacttccccatcatcggcgtgaaggagaagaccttcgagcagctgcacaagaagtgcctggagaagaaggtgctgtacgtggaccccgagttcccccccgacgagaccagcctgttctacagccagaagttccccatccagttcgtgtggaagcgcccccccgagatctgcgagaacccccgcttcatcatcgacggcgccaaccgcaccgacatctgccagggcgagctgggcgactgctggttcctggccgccatcgcctgcctgaccctgaaccagcacctgctgttccgcgtgatcccccacgaccagagcttcatcgagaactacgccggcatcttccacttccagttctggcgctacggcgagtgggtggacgtggtgatcgacgactgcctgcccacctacaacaaccagctggtgttcaccaagagcaaccaccgcaacgagttctggagcgccctgctggagaaggcctacgccaagctgcacggcagctacgaggccctgaagggcggcaacaccaccgaggccatggaggacttcaccggcggcgtggccgagttcttcgagatccgcgacgcccccagcgacatgtacaagatcatgaagaaggccatcgagcgcggcagcctgatgggctgcagcatcgacgacggcaccaacatgacctacggcaccagccccagcggcctgaacatgggcgagctgatcgcccgcatggtgcgcaacatggacaacagcctgctgcaggacagcgacctggacccccgcggcagcgacgagcgccccacccgcaccatcatccccgtgcagtacgagacccgcatggcctgcggcctggtgcgcggccacgcctacagcgtgaccggcctggacgaggtgcccttcaagggcgagaaggtgaagctggtgcgcctgcgcaacccctggggccaggtggagtggaacggcagctggagcgaccgctggaaggactggagcttcgtggacaaggacgagaaggcccgcctgcagcaccaggtgaccgaggacggcgagttctggatgagctacgaggacttcatctaccacttcaccaagctggagatctgcaacctgaccgccgacgccctgcagagcgacaagctgcagacctggaccgtgagcgtgaacgagggccgctgggtgcgcggctgcagcgccggcggctgccgcaacttccccgacaccttctggaccaacccccagtaccgcctgaagctgctggaggaggacgacgaccccgacgacagcgaggtgatctgcagcttcctggtggccctgatgcagaagaaccgccgcaaggaccgcaagctgggcgccagcctgttcaccatcggcttcgccatctacgaggtgcccaaggagatgcacggcaacaagcagcacctgcagaaggacttcttcctgtacaacgccagcaaggcccgcagcaagacctacatcaacatgcgcgaggtgagccagcgcttccgcctgccccccagcgagtacgtgatcgtgcccagcacctacgagccccaccaggagggcgagttcatcctgcgcgtgttcagcgagaagcgcaacctgagcgaggaggtggagaacaccatcagcgtggaccgccccgtgaagaagaagaagaccaagcccatcatcttcgtgagcgaccgcgccaacagcaacaaggagctgggcgtggaccaggagagcgaggagggcaagggcaagaccagccccgacaagcagaagcagagcccccagccccagcccggcagcagcgaccaggagagcgaggagcagcagcagttccgcaacatcttcaagcagatcgccggcgacgacatggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35560 - DNA, 927 bp, Artificial Sequence
  Description of Artificial Sequence: Synthetic coding sequence
atgcacggcaacaagcagcacctgcagaaggacttcttcctgtacaacgccagcaaggcccgcagcaagacctacatcaacatgcgcgaggtgagccagcgcttccgcctgccccccagcgagtacgtgatcgtgcccagcacctacgagccccaccaggagggcgagttcatcctgcgcgtgttcagcgagaagcgcaacctgagcgaggaggtggagaacaccatcagcgtggaccgccccgtgaagaagaagaagaccaagcccatcatcttcgtgagcgaccgcgccaacagcaacaaggagctgggcgtggaccaggagagcgaggagggcaagggcaagaccagccccgacaagcagaagcagagcccccagccccagcccggcagcagcgaccaggagagcgaggagcagcagcagttccgcaacatcttcaagcagatcgccggcgacgacatggagatctgcgccgacgagctgaagaaggtgctgaacaccgtggtgaacaagcacaaggacctgaagacccacggcttcaccctggagagctgccgcagcatgatcgccctgatggacaccgacggcagcggcaagctgaacctgcaggagttccaccacctgtggaacaagatcaaggcctggcagaagatcttcaagcactacgacaccgaccagagcggcaccatcaacagctacgagatgcgcaacgccgtgaacgacgccggcttccacctgaacaaccagctgtacgacatcatcaccatgcgctacgccgacaagcacatgaacatcgacttcgacagcttcatctgctgcttcgtgcgcctggagggcatgttccgcgccttccacgccttcgacaaggacggcgacggcatcatcaagctgaacgtgctggagtggctgcagctgaccatgtacgcc

SEQ ID NO: 35561 - DNA, 1845 bp, Artificial Sequence
  Description of Artificial Sequence: Synthetic coding sequence
atgcgcgccctgctgctgctgggcttcctgctggtgagcctggagagcaccctgagcatccccccctgggaggcccccaaggagcacaagtacaaggccgaggagcacaccgtggtgctgaccgtgaccggcgagccctgccacttccccttccagtaccaccgccagctgtaccacaagtgcacccacaagggccgccccggcccccagccctggtgcgccaccacccccaacttcgaccaggaccagcgctggggctactgcctggagcccaagaaggtgaaggaccactgcagcaagcacagcccctgccagaagggcggcacctgcgtgaacatgcccagcggcccccactgcctgtgcccccagcacctgaccggcaaccactgccagaaggagaagtgcttcgagccccagctgctgcgcttcttccacaagaacgagatctggtaccgcaccgagcaggccgccgtggcccgctgccagtgcaagggccccgacgcccactgccagcgcctggccagccaggcctgccgcaccaacccctgcctgcacggcggccgctgcctggaggtggagggccaccgcctgtgccactgccccgtgggctacaccggcgccttctgcgacgtggacaccaaggccagctgctacgacggccgcggcctgagctaccgcggcctggcccgcaccaccctgagcggcgccccctgccagccctgggccagcgaggccacctaccgcaacgtgaccgccgagcaggcccgcaactggggcctgggcggccacgccttctgccgcaaccccgacaacgacatccgcccctggtgcttcgtgctgaaccgcgaccgcctgagctgggagtactgcgacctggcccagtgccagacccccacccaggccgccccccccacccccgtgagcccccgcctgcacgtgcccctgatgcccgcccagcccgccccccccaagccccagcccaccacccgcacccccccccagagccagacccccggcgccctgcccgccaagcgcgagcagccccccagcctgacccgcaacggccccctgagctgcggccagcgcctgcgcaagagcctgagcagcatgacccgcgtggtgggcggcctggtggccctgcgcggcgcccacccctacatcgccgccctgtactggggccacagcttctgcgccggcagcctgatcgccccctgctgggtgctgaccgccgcccactgcctgcaggaccgccccgcccccgaggacctgaccgtggtgctgggccaggagcgccgcaaccacagctgcgagccctgccagaccctggccgtgcgcagctaccgcctgcacgaggccttcagccccgtgagctaccagcacgacctggccctgctgcgcctgcaggaggacgccgacggcagctgcgccctgctgagcccctacgtgcagcccgtgtgcctgcccagcggcgccgcccgccccagcgagaccaccctgtgccaggtggccggctggggccaccagttcgagggcgccgaggagtacgccagcttcctgcaggaggcccaggtgcccttcctgagcctggagcgctgcagcgcccccgacgtgcacggcagcagcatcctgcccggcatgctgtgcgccggcttcctggagggcggcaccgacgcctgccagggcgacagcggcggccccctggtgtgcgaggaccaggccgccgagcgccgcctgaccctgcagggcatcatcagctggggcagcggctgcggcgaccgcaacaagcccggcgtgtacaccgacgtggcctactacctggcctggatccgcgagcacaccgtgagc

SEQ ID NO: 35562 - DNA, 1512 bp, Artificial Sequence
  Description of Artificial Sequence: Synthetic coding sequence
atgatgaccaccagcctgatctggggcatcgccatcgccgcctgctgctgcctgtggctgatcctgggcatccgccgccgccagaccggcgagccccccctggagaacggcctgatcccctacctgggctgcgccctgcagttcggcgccaaccccctggagttcctgcgcgccaaccagcgcaagcacggccacgtgttcacctgcaagctgatgggcaagtacgtgcacttcatcaccaaccccctgagctaccacaaggtgctgtgccacggcaagtacttcgactggaagaagttccacttcgccaccagcgccaaggccttcggccaccgcagcatcgaccccatggacggcaacaccaccgagaacatcaacgacaccttcatcaagaccctgcagggccacgccctgaacagcctgaccgagagcatgatggagaacctgcagcgcatcatgcgcccccccgtgagcagcaacagcaagaccgccgcctgggtgaccgagggcatgtacagcttctgctaccgcgtgatgttcgaggccggctacctgaccatcttcggccgcgacctgacccgccgcgacacccagaaggcccacatcctgaacaacctggacaacttcaagcagttcgacaaggtgttccccgccctggtggccggcctgcccatccacatgttccgcaccgcccacaacgcccgcgagaagctggccgagagcctgcgccacgagaacctgcagaagcgcgagagcatcagcgagctgatcagcctgcgcatgttcctgaacgacaccctgagcaccttcgacgacctggagaaggccaagacccacctggtggtgctgtgggccagccaggccaacaccatccccgccaccttctggagcctgttccagatgatccgcaaccccgaggccatgaaggccgccaccgaggaggtgaagcgcaccctggagaacgccggccagaaggtgagcctggagggcaaccccatctgcctgagccaggccgagctgaacgacctgcccgtgctggacagcatcatcaaggagagcctgcgcctgagcagcgccagcctgaacatccgcaccgccaaggaggacttcaccctgcacctggaggacggcagctacaacatccgcaaggacgacatcatcgccctgtacccccagctgatgcacctggaccccgagatctaccccgaccccctgaccttcaagtacgaccgctacctggacgagaacggcaagaccaagaccaccttctactgcaacggcctgaagctgaagtactactacatgcccttcggcagcggcgccaccatctgccccggccgcctgttcgccatccacgagatcaagcagttcctgatcctgatgctgagctacttcgagctggagctgatcgagggccaggccaagtgcccccccctggaccagagccgcgccggcctgggcatcctgccccccctgaacgacatcgagttcaagtacaagttcaagcacctg

SEQ ID NO: 35563 - DNA, 1887 bp, Artificial Sequence
  Description of Artificial Sequence: Synthetic coding sequence
atgagcgccgaggtgcgcctgcgccgcctgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgcgcctgaaggaggtgcgcctgcagcgcgacgacttcgagatcctgaaggtgatcggccgcggcgccttcagcgaggtggccgtggtgaagatgaagcagaccggccaggtgtacgccatgaagatcatgaacaagtgggacatgctgaagcgcggcgaggtgagctgcttccgcgaggagcgcgacgtgctggtgaacggcgaccgccgctggatcacccagctgcacttcgccttccaggacgagaactacctgtacctggtgatggagtactacgtgggcggcgacctgctgaccctgctgagcaagttcggcgagcgcatccccgccgagatggcccgcttctacctggccgagatcgtgatggccatcgacagcgtgcaccgcctgggctacgtgcaccgcgacatcaagcccgacaacatcctgctggaccgctgcggccacatccgcctggccgacttcggcagctgcctgaagctgcgcgccgacggcaccgtgcgcagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggcccgcgacttcatccagcgcctgctgtgcccccccgagacccgcctgggccgcggcggcgccggcgacttccgcacccaccccttcttcttcggcctggactgggacggcctgcgcgacagcgtgccccccttcacccccgacttcgagggcgccaccgacacctgcaacttcgacctggtggaggacggcctgaccgccatggtgagcggcggcggcgagaccctgagcgacatccgcgagggcgcccccctgggcgtgcacctgcccttcgtgggctacagctacagctgcatggccctgcgcgacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgcgcgagctgcaggaggccctggaggaggaggtgctgacccgccagagcctgagccgcgagatggaggccatccgcaccgacaaccagaacttcgccagccagctgcgcgaggccgaggcccgcaaccgcgacctggaggcccacgtgcgccagctgcaggagcgcatggagctgctgcaggccgagggcgccaccgccgtgaccggcgtgcccagcccccgcgccaccgacccccccagccacctggacggcccccccgccgtggccgtgggccagtgccccctggtgggccccggccccatgcaccgccgccacctgctgctgcccgcccgcgtgccccgccccggcctgagcgaggccctgagcctgctgctgttcgccgtggtgctgagccgcgccgccgccctgggctgcatcggcctggtggcccacgccggccagctgaccgccgtgtggcgccgccccggcgccgcccgcgccccc

SEQ ID NO: 35564 - DNA, 1917 bp, Artificial Sequence
  Description of Artificial Sequence: Synthetic coding sequence
atgggcggccacttctggccccccgagccctacaccgtgttcatgtggggcagcccctgggaggccgacagcccccgcgtgaagctgcgcggccgcgagaagggccgccagaccgagggcggcgccttccccctggtgagcagcgccctgagcggcgacccccgcttcttcagccccaccaccccccccgccgagcccatcgtggtgcgcctgaaggaggtgcgcctgcagcgcgacgacttcgagatcctgaaggtgatcggccgcggcgccttcagcgaggtggccgtggtgaagatgaagcagaccggccaggtgtacgccatgaagatcatgaacaagtgggacatgctgaagcgcggcgaggtgagctgcttccgcgaggagcgcgacgtgctggtgaacggcgaccgccgctggatcacccagctgcacttcgccttccaggacgagaactacctgtacctggtgatggagtactacgtgggcggcgacctgctgaccctgctgagcaagttcggcgagcgcatccccgccgagatggcccgcttctacctggccgagatcgtgatggccatcgacagcgtgcaccgcctgggctacgtgcaccgcgacatcaagcccgacaacatcctgctggaccgctgcggccacatccgcctggccgacttcggcagctgcctgaagctgcgcgccgacggcaccgtgcgcagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggcccgcgacttcatccagcgcctgctgtgcccccccgagacccgcctgggccgcggcggcgccggcgacttccgcacccaccccttcttcttcggcctggactgggacggcctgcgcgacagcgtgccccccttcacccccgacttcgagggcgccaccgacacctgcaacttcgacctggtggaggacggcctgaccgccatggtgagcggcggcggcgagaccctgagcgacatccgcgagggcgcccccctgggcgtgcacctgcccttcgtgggctacagctacagctgcatggccctgcgcgacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgcgcgagctgcaggaggccctggaggaggaggtgctgacccgccagagcctgagccgcgagatggaggccatccgcaccgacaaccagaacttcgccagccagctgcgcgaggccgaggcccgcaaccgcgacctggaggcccacgtgcgccagctgcaggagcgcatggagctgctgcaggccgagggcgccaccgccgtgaccggcgtgcccagcccccgcgccaccgacccccccagccacctggacggcccccccgccgtggccgtgggccagtgccccctggtgggccccggccccatgcaccgccgccacctgctgctgcccgcccgcgtgccccgccccggcctgagcgaggccctgagcctgctgctgttcgccgtggtgctgagccgcgccgccgccctgggctgcatcggcctggtggcccacgccggccagctgaccgccgtgtggcgccgccccggcgccgcccgcgccccc

SEQ ID NO: 35565 - DNA, 1590 bp, Artificial Sequence
  Description of Artificial Sequence: Synthetic coding sequence
atgagcgccgaggtgcgcctgcgccgcctgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgcgcctgaaggaggtgcgcctgcagcgcgacgacttcgagatcctgaaggtgatcggccgcggcgccttcagcgaggtggccgtggtgaagatgaagcagaccggccaggtgtacgccatgaagatcatgaacaagtgggacatgctgaagcgcggcgaggtgagctgcttccgcgaggagcgcgacgtgctggtgaacggcgaccgccgctggatcacccagctgcacttcgccttccaggacgagaactacctgtacctggtgatggagtactacgtgggcggcgacctgctgaccctgctgagcaagttcggcgagcgcatccccgccgagatggcccgcttctacctggccgagatcgtgatggccatcgacagcgtgcaccgcctgggctacgtgcaccgcgacatcaagcccgacaacatcctgctggaccgctgcggccacatccgcctggccgacttcggcagctgcctgaagctgcgcgccgacggcaccgtgcgcagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggcccgcgacttcatccagcgcctgctgtgcccccccgagacccgcctgggccgcggcggcgccggcgacttccgcacccaccccttcttcttcggcctggactgggacggcctgcgcgacagcgtgccccccttcacccccgacttcgagggcgccaccgacacctgcaacttcgacctggtggaggacggcctgaccgccatggagaccctgagcgacatccgcgagggcgcccccctgggcgtgcacctgcccttcgtgggctacagctacagctgcatggccctgcgcgacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgcgcgagctgcaggaggccctggaggaggaggtgctgacccgccagagcctgagccgcgagatggaggccatccgcaccgacaaccagaacttcgccagccagctgcgcgaggccgaggcccgcaaccgcgacctggaggcccacgtgcgccagctgcaggagcgcatggagctgctgcaggccgagggcgccaccggcccc

SEQ ID NO: 35566 - DNA, 1872 bp, Artificial Sequence
  Description of Artificial Sequence: Synthetic coding sequence
atgagcgccgaggtgcgcctgcgccgcctgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgcgcctgaaggaggtgcgcctgcagcgcgacgacttcgagatcctgaaggtgatcggccgcggcgccttcagcgaggtggccgtggtgaagatgaagcagaccggccaggtgtacgccatgaagatcatgaacaagtgggacatgctgaagcgcggcgaggtgagctgcttccgcgaggagcgcgacgtgctggtgaacggcgaccgccgctggatcacccagctgcacttcgccttccaggacgagaactacctgtacctggtgatggagtactacgtgggcggcgacctgctgaccctgctgagcaagttcggcgagcgcatccccgccgagatggcccgcttctacctggccgagatcgtgatggccatcgacagcgtgcaccgcctgggctacgtgcaccgcgacatcaagcccgacaacatcctgctggaccgctgcggccacatccgcctggccgacttcggcagctgcctgaagctgcgcgccgacggcaccgtgcgcagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggcccgcgacttcatccagcgcctgctgtgcccccccgagacccgcctgggccgcggcggcgccggcgacttccgcacccaccccttcttcttcggcctggactgggacggcctgcgcgacagcgtgccccccttcacccccgacttcgagggcgccaccgacacctgcaacttcgacctggtggaggacggcctgaccgccatggagaccctgagcgacatccgcgagggcgcccccctgggcgtgcacctgcccttcgtgggctacagctacagctgcatggccctgcgcgacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgcgcgagctgcaggaggccctggaggaggaggtgctgacccgccagagcctgagccgcgagatggaggccatccgcaccgacaaccagaacttcgccagccagctgcgcgaggccgaggcccgcaaccgcgacctggaggcccacgtgcgccagctgcaggagcgcatggagctgctgcaggccgagggcgccaccgccgtgaccggcgtgcccagcccccgcgccaccgacccccccagccacctggacggcccccccgccgtggccgtgggccagtgccccctggtgggccccggccccatgcaccgccgccacctgctgctgcccgcccgcgtgccccgccccggcctgagcgaggccctgagcctgctgctgttcgccgtggtgctgagccgcgccgccgccctgggctgcatcggcctggtggcccacgccggccagctgaccgccgtgtggcgccgccccggcgccgcccgcgccccc

SEQ ID NO: 35567 - DNA, 1875 bp, Artificial Sequence
  Description of Artificial Sequence: Synthetic coding sequence
atgagcgccgaggtgcgcctgcgccgcctgcagcagctggtgctggaccccggcttcctgggcctggagcccctgctggacctgctgctgggcgtgcaccaggagctgggcgccagcgagctggcccaggacaagtacgtggccgacttcctgcagtgggccgagcccatcgtggtgcgcctgaaggaggtgcgcctgcagcgcgacgacttcgagatcctgaaggtgatcggccgcggcgccttcagcgaggtggccgtggtgaagatgaagcagaccggccaggtgtacgccatgaagatcatgaacaagtgggacatgctgaagcgcggcgaggtgagctgcttccgcgaggagcgcgacgtgctggtgaacggcgaccgccgctggatcacccagctgcacttcgccttccaggacgagaactacctgtacctggtgatggagtactacgtgggcggcgacctgctgaccctgctgagcaagttcggcgagcgcatccccgccgagatggcccgcttctacctggccgagatcgtgatggccatcgacagcgtgcaccgcctgggctacgtgcaccgcgacatcaagcccgacaacatcctgctggaccgctgcggccacatccgcctggccgacttcggcagctgcctgaagctgcgcgccgacggcaccgtgcgcagcctggtggccgtgggcacccccgactacctgagccccgagatcctgcaggccgtgggcggcggccccggcaccggcagctacggccccgagtgcgactggtgggccctgggcgtgttcgcctacgagatgttctacggccagacccccttctacgccgacagcaccgccgagacctacggcaagatcgtgcactacaaggagcacctgagcctgcccctggtggacgagggcgtgcccgaggaggcccgcgacttcatccagcgcctgctgtgcccccccgagacccgcctgggccgcggcggcgccggcgacttccgcacccaccccttcttcttcggcctggactgggacggcctgcgcgacagcgtgccccccttcacccccgacttcgagggcgccaccgacacctgcaacttcgacctggtggaggacggcctgaccgccatggagaccctgagcgacatccgcgagggcgcccccctgggcgtgcacctgcccttcgtgggctacagctacagctgcatggccctgcgcgacagcgaggtgcccggccccacccccatggagctggaggccgagcagctgctggagccccacgtgcaggcccccagcctggagcccagcgtgagcccccaggacgagaccgccgaggtggccgtgcccgccgccgtgcccgccgccgaggccgaggccgaggtgaccctgcgcgagctgcaggaggccctggaggaggaggtgctgacccgccagagcctgagccgcgagatggaggccatccgcaccgacaaccagaacttcgccagccagctgcgcgaggccgaggcccgcaaccgcgacctggaggcccacgtgcgccagctgcaggagcgcatggagctgctgcaggccgagggcgccaccgccgtgaccggcgtgcccagcccccgcgccaccgacccccccagccacatggccccccgcccctggctgtgggccagcgcccgctggtggggccaggccccctgcaccgccgccacctgctgcagcctgcccggcagcctgggcctggcctaccgccgccgcttcccctgcagctgcagccccctgttctgcctggtgccccccccctgggccgccctgggctggtggcccacccccgccaacagcccccagagcggcgccgcccaggagccccccgccctgcccgagccc

SEQ ID NO: 35568 - DNA, 126 bp, Artificial Sequence
  Description of Artificial Sequence: Synthetic coding sequence
atggagctgctgcaggccgagggcgccaccgcccgctggccccccggccgcggctgcggccccgtgcccgccggcggcgcccgcccccacgccccccccccccccgccgccccctgccagggcccc

SEQ ID NO: 35569 - DNA, 3399 bp, Artificial Sequence
  Description of Artificial Sequence: Synthetic coding sequence
atgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagaccaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccacaacgtgggcagcctgttccacatggccgacgacctgggccgcgccatggagagcctggtgagcgtgatgaccgacgaggagggcgccgag

SEQ ID NO: 35570 - DNA, 11055 bp, Artificial Sequence
  Description of Artificial Sequence: Synthetic coding sequence
atgctgtggtgggaggaggtggaggactgctacgagcgcgaggacgtgcagaagaagaccttcaccaagtgggtgaacgcccagttcagcaagttcggcaagcagcacatcgagaacctgttcagcgacctgcaggacggccgccgcctgctggacctgctggagggcctgaccggccagaagctgcccaaggagaagggcagcacccgcgtgcacgccctgaacaacgtgaacaaggccctgcgcgtgctgcagaacaacaacgtggacctggtgaacatcggcagcaccgacatcgtggacggcaaccacaagctgaccctgggcctgatctggaacatcatcctgcactggcaggtgaagaacgtgatgaagaacatcatggccggcctgcagcagaccaacagcgagaagatcctgctgagctgggtgcgccagagcacccgcaactacccccaggtgaacgtgatcaacttcaccaccagctggagcgacggcctggccctgaacgccctgatccacagccaccgccccgacctgttcgactggaacagcgtggtgtgccagcagagcgccacccagcgcctggagcacgccttcaacatcgcccgctaccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgccccgcccccccaaggtgaccaaggaggagcacttccagctgcaccaccagatgcactacagccagcagatcaccgtgagcctggcccagggctacgagcgcaccagcagccccaagccccgcttcaagagctacgcctacacccaggccgcctacgtgaccaccagcgaccccacccgcagccccttccccagccagcacctggaggcccccgaggacaagagcttcggcagcagcctgatggagagcgaggtgaacctggaccgctaccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggccgcgtgggcaacatcctgcagctgggcagcaagctgatcggcaccggcaagctgagcgaggacgaggagaccgaggtgcaggagcagatgaacctgctgaacagccgctgggagtgcctgcgcgtggccagcatggagaagcagagcaacctgcaccgcgtgctgatggacctgcagaaccagaagctgaaggagctgaacgactggctgaccaagaccgaggagcgcacccgcaagatggaggaggagcccctgggccccgacctggaggacctgaagcgccaggtgcagcagcacaaggtgctgcaggaggacctggagcaggagcaggtgcgcgtgaacagcctgacccacatggtggtggtggtggacgagagcagcggcgaccacgccaccgccgccctggaggagcagctgaaggtgctgggcgaccgctgggccaacatctgccgctggaccgaggaccgctgggtgctgctgcaggacatcctgctgaagtggcagcgcctgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgcccgctgctgggacaacctggtgcagaagctggagaagagcaccgcccagatcagccaggccgtgaccaccacccagcccagcctgacccagaccaccgtgatggagaccgtgaccaccgtgaccacccgcgagcagatcctggtgaagcacgcccaggaggagctgccccccccccccccccagaagaagcgccagatcaccgtggacagcgagatccgcaagcgcctggacgtggacatcaccgagctgcacagctggatcacccgcagcgaggccgtgctgcagagccccgagttcgccatcttccgcaaggagggcaacttcagcgacctgaaggagaaggtgaacgccatcgagcgcgagaaggccgagaagttccgcaagctgcaggacgccagccgcagcgcccaggccctggtggagcagatggtgaacgagggcgtgaacgccgacagcatcaagcaggccagcgagcagctgaacagccgctggatcgagttctgccagctgctgagcgagcgcctgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaaccgcctgagcgacctgcagccccagatcgagcgcctgaagatccagagcatcgccctgaaggagaagggccagggccccatgttcctggacgccgacttcgtggccttcaccaaccacttcaagcaggtgttcagcgacgtgcaggcccgcgagaaggagctgcagaccatcttcgacaccctgccccccatgcgctaccaggagaccatgagcgccatccgcacctgggtgcagcagagcgagaccaagctgagcatcccccagctgagcgtgaccgactacgagatcatggagcagcgcctgggcgagctgcaggccctgcagagcagcctgcaggagcagcagagcggcctgtactacctgagcaccaccgtgaaggagatgagcaagaaggcccccagcgagatcagccgcaagtaccagagcgagttcgaggagatcgagggccgctggaagaagctgagcagccagctggtggagcactgccagaagctggaggagcagatgaacaagctgcgcaagatccagaaccacatccagaccctgaagaagtggatggccgaggtggacgtgttcctgaaggaggagtggcccgccctgggcgacagcgagatcctgaagaagcagctgaagcagtgccgcctgctggtgagcgacatccagaccatccagcccagcctgaacagcgtgaacgagggcggccagaagatcaagaacgaggccgagcccgagttcgccagccgcctggagaccgagctgaaggagctgaacacccagtgggaccacatgtgccagcaggtgtacgcccgcaaggaggccctgaagggcggcctggagaagaccgtgagcctgcagaaggacctgagcgagatgcacgagtggatgacccaggccgaggaggagtacctggagcgcgacttcgagtacaagacccccgacgagctgcagaaggccgtggaggagatgaagcgcgccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcacccgcctgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgcgccacagcgaggacaaccccaaccagatccgcatcctggcccagaccctgaccgacggcggcgtgatggacgagctgatcaacgaggagctggagaccttcaacagccgctggcgcgagctgcacgaggaggccgtgcgccgccagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagcgcgtgctgagccagatcgacgtggcccagaagaagctgcaggacgtgagcatgaagttccgcctgttccagaagcccgccaacttcgagcagcgcctgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggccgccagatcgtgcagaagaagcagaccgagaaccccaaggagctggacgagcgcgtgaccgccctgaagctgcactacaacgagctgggcgccaaggtgaccgagcgcaagcagcagctggagaagtgcctgaagctgagccgcaagatgcgcaaggagatgaacgtgctgaccgagtggctggccgccaccgacatggagctgaccaagcgcagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagccgcgccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagcgcctgaaggccgagctgaacgacatccgccccaaggtggacagcacccgcgaccaggccgccaacctgatggccaaccgcggcgaccactgccgcaagctggtggagccccagatcagcgagctgaaccaccgcttcgccgccatcagccaccgcatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagcgcggcgacaacctgcagcagcgcatcaccgacgagcgcaagcgcgaggagatcaagatcaagcagcagctgctgcagaccaagcacaacgccctgaaggacctgcgcagccagcgccgcaagaaggccctggagatcagccaccagtggtaccagtacaagcgccaggccgacgacctgctgaagtgcctggacgacatcgagaagaagctggccagcctgcccgagccccgcgacgagcgcaagatcaaggagatcgaccgcgagctgcagaagaagaaggaggagctgaacgccgtgcgccgccaggccgagggcctgagcgaggacggcgccgccatggccgtggagcccacccagatccagctgagcaagcgctggcgcgagatcgagagcaagttcgcccagttccgccgcctgaacttcgcccagatccacaccgtgcgcgaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggccgcatcgacatcatccacagcaagaagaccgccgccctgcagagcgccacccccgtggagcgcgtgaagctgcaggaggccctgagccagctggacttccagtgggagaaggtgaacaagatgtacaaggaccgccagggccgcttcgaccgcagcgtggagaagtggcgccgcttccactacgacatcaagatcttcaaccagtggctgaccgaggccgagcagttcctgcgcaagacccagatccccgagaactgggagcacgccaagtacaagtggtacctgaaggagctgcaggacggcatcggccagcgccagaccgtggtgcgcaccctgaacgccaccggcgaggagatcatccagcagagcagcaagaccgacgccagcatcctgcaggagaagctgggcagcctgaacctgcgctggcaggaggtgtgcaagcagctgagcgaccgcaagaagcgcctggaggagcagaagaacatcctgagcgagttccagcgcgacctgaacgagttcgtgctgtggctggaggaggccgacaacatcgccagcatccccctggagcccggcaaggagcagcagctgaaggagaagctggagcaggtgaagctgctggtggaggagctgcccctgcgccagggcatcctgaagcagctgaacgagaccggcggccccgtgctggtgagcgcccccatcagccccgaggagcaggacaagctggagaacaagctgaagcagaccaacctgcagtggatcaaggtgagccgcgccctgcccgagaagcagggcgagatcgaggcccagatcaaggacctgggccagctggagaagaagctggaggacctggaggagcagctgaaccacctgctgctgtggctgagccccatccgcaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagcgcaagctggaggacctgagcagcgagtggaaggccgtgaaccgcctgctgcaggagctgcgcgccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgtgaccctgatcaacttctggcccgtggacagcgcccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccgcaacacccccggcaagcccatgcgcgaggacaccatg

SEQ ID NO: 35571 - DNA, 3690 bp, Artificial Sequence
  Description of Artificial Sequence: Synthetic coding sequence
atgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccacaacgtgggcagcctgttccacatggccgacgacctgggccgcgccatggagagcctggtgagcgtgatgaccgacgaggagggcgccgag

SEQ ID NO: 35572 - DNA, 1866 bp, Artificial Sequence
  Description of Artificial Sequence: Synthetic coding sequence
atgcgcgagcagctgaagggccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccacaacgtgggcagcctgttccacatggccgacgacctgggccgcgccatggagagcctggtgagcgtgatgaccgacgaggagggcgccgag

SEQ ID NO: 35573 - DNA, 11043 bp, Artificial Sequence
  Description of Artificial Sequence: Synthetic coding sequence
atgagcgaggtgagcagcgacgagcgcgaggacgtgcagaagaagaccttcaccaagtgggtgaacgcccagttcagcaagttcggcaagcagcacatcgagaacctgttcagcgacctgcaggacggccgccgcctgctggacctgctggagggcctgaccggccagaagctgcccaaggagaagggcagcacccgcgtgcacgccctgaacaacgtgaacaaggccctgcgcgtgctgcagaacaacaacgtggacctggtgaacatcggcagcaccgacatcgtggacggcaaccacaagctgaccctgggcctgatctggaacatcatcctgcactggcaggtgaagaacgtgatgaagaacatcatggccggcctgcagcagaccaacagcgagaagatcctgctgagctgggtgcgccagagcacccgcaactacccccaggtgaacgtgatcaacttcaccaccagctggagcgacggcctggccctgaacgccctgatccacagccaccgccccgacctgttcgactggaacagcgtggtgtgccagcagagcgccacccagcgcctggagcacgccttcaacatcgcccgctaccagctgggcatcgagaagctgctggaccccgaggacgtggacaccacctaccccgacaagaagagcatcctgatgtacatcaccagcctgttccaggtgctgccccagcaggtgagcatcgaggccatccaggaggtggagatgctgccccgcccccccaaggtgaccaaggaggagcacttccagctgcaccaccagatgcactacagccagcagatcaccgtgagcctggcccagggctacgagcgcaccagcagccccaagccccgcttcaagagctacgcctacacccaggccgcctacgtgaccaccagcgaccccacccgcagccccttccccagccagcacctggaggcccccgaggacaagagcttcggcagcagcctgatggagagcgaggtgaacctggaccgctaccagaccgccctggaggaggtgctgagctggctgctgagcgccgaggacaccctgcaggcccagggcgagatcagcaacgacgtggaggtggtgaaggaccagttccacacccacgagggctacatgatggacctgaccgcccaccagggccgcgtgggcaacatcctgcagctgggcagcaagctgatcggcaccggcaagctgagcgaggacgaggagaccgaggtgcaggagcagatgaacctgctgaacagccgctgggagtgcctgcgcgtggccagcatggagaagcagagcaacctgcaccgcgtgctgatggacctgcagaaccagaagctgaaggagctgaacgactggctgaccaagaccgaggagcgcacccgcaagatggaggaggagcccctgggccccgacctggaggacctgaagcgccaggtgcagcagcacaaggtgctgcaggaggacctggagcaggagcaggtgcgcgtgaacagcctgacccacatggtggtggtggtggacgagagcagcggcgaccacgccaccgccgccctggaggagcagctgaaggtgctgggcgaccgctgggccaacatctgccgctggaccgaggaccgctgggtgctgctgcaggacatcctgctgaagtggcagcgcctgaccgaggagcagtgcctgttcagcgcctggctgagcgagaaggaggacgccgtgaacaagatccacaccaccggcttcaaggaccagaacgagatgctgagcagcctgcagaagctggccgtgctgaaggccgacctggagaagaagaagcagagcatgggcaagctgtacagcctgaagcaggacctgctgagcaccctgaagaacaagagcgtgacccagaagaccgaggcctggctggacaacttcgcccgctgctgggacaacctggtgcagaagctggagaagagcaccgcccagatcagccaggccgtgaccaccacccagcccagcctgacccagaccaccgtgatggagaccgtgaccaccgtgaccacccgcgagcagatcctggtgaagcacgcccaggaggagctgccccccccccccccccagaagaagcgccagatcaccgtggacagcgagatccgcaagcgcctggacgtggacatcaccgagctgcacagctggatcacccgcagcgaggccgtgctgcagagccccgagttcgccatcttccgcaaggagggcaacttcagcgacctgaaggagaaggtgaacgccatcgagcgcgagaaggccgagaagttccgcaagctgcaggacgccagccgcagcgcccaggccctggtggagcagatggtgaacgagggcgtgaacgccgacagcatcaagcaggccagcgagcagctgaacagccgctggatcgagttctgccagctgctgagcgagcgcctgaactggctggagtaccagaacaacatcatcgccttctacaaccagctgcagcagctggagcagatgaccaccaccgccgagaactggctgaagatccagcccaccacccccagcgagcccaccgccatcaagagccagctgaagatctgcaaggacgaggtgaaccgcctgagcgacctgcagccccagatcgagcgcctgaagatccagagcatcgccctgaaggagaagggccagggccccatgttcctggacgccgacttcgtggccttcaccaaccacttcaagcaggtgttcagcgacgtgcaggcccgcgagaaggagctgcagaccatcttcgacaccctgccccccatgcgctaccaggagaccatgagcgccatccgcacctgggtgcagcagagcgagaccaagctgagcatcccccagctgagcgtgaccgactacgagatcatggagcagcgcctgggcgagctgcaggccctgcagagcagcctgcaggagcagcagagcggcctgtactacctgagcaccaccgtgaaggagatgagcaagaaggcccccagcgagatcagccgcaagtaccagagcgagttcgaggagatcgagggccgctggaagaagctgagcagccagctggtggagcactgccagaagctggaggagcagatgaacaagctgcgcaagatccagaaccacatccagaccctgaagaagtggatggccgaggtggacgtgttcctgaaggaggagtggcccgccctgggcgacagcgagatcctgaagaagcagctgaagcagtgccgcctgctggtgagcgacatccagaccatccagcccagcctgaacagcgtgaacgagggcggccagaagatcaagaacgaggccgagcccgagttcgccagccgcctggagaccgagctgaaggagctgaacacccagtgggaccacatgtgccagcaggtgtacgcccgcaaggaggccctgaagggcggcctggagaagaccgtgagcctgcagaaggacctgagcgagatgcacgagtggatgacccaggccgaggaggagtacctggagcgcgacttcgagtacaagacccccgacgagctgcagaaggccgtggaggagatgaagcgcgccaaggaggaggcccagcagaaggaggccaaggtgaagctgctgaccgagagcgtgaacagcgtgatcgcccaggccccccccgtggcccaggaggccctgaagaaggagctggagaccctgaccaccaactaccagtggctgtgcacccgcctgaacggcaagtgcaagaccctggaggaggtgtgggcctgctggcacgagctgctgagctacctggagaaggccaacaagtggctgaacgaggtggagttcaagctgaagaccaccgagaacatccccggcggcgccgaggagatcagcgaggtgctggacagcctggagaacctgatgcgccacagcgaggacaaccccaaccagatccgcatcctggcccagaccctgaccgacggcggcgtgatggacgagctgatcaacgaggagctggagaccttcaacagccgctggcgcgagctgcacgaggaggccgtgcgccgccagaagctgctggagcagagcatccagagcgcccaggagaccgagaagagcctgcacctgatccaggagagcctgaccttcatcgacaagcagctggccgcctacatcgccgacaaggtggacgccgcccagatgccccaggaggcccagaagatccagagcgacctgaccagccacgagatcagcctggaggagatgaagaagcacaaccagggcaaggaggccgcccagcgcgtgctgagccagatcgacgtggcccagaagaagctgcaggacgtgagcatgaagttccgcctgttccagaagcccgccaacttcgagcagcgcctgcaggagagcaagatgatcctggacgaggtgaagatgcacctgcccgccctggagaccaagagcgtggagcaggaggtggtgcagagccagctgaaccactgcgtgaacctgtacaagagcctgagcgaggtgaagagcgaggtggagatggtgatcaagaccggccgccagatcgtgcagaagaagcagaccgagaaccccaaggagctggacgagcgcgtgaccgccctgaagctgcactacaacgagctgggcgccaaggtgaccgagcgcaagcagcagctggagaagtgcctgaagctgagccgcaagatgcgcaaggagatgaacgtgctgaccgagtggctggccgccaccgacatggagctgaccaagcgcagcgccgtggagggcatgcccagcaacctggacagcgaggtggcctggggcaaggccacccagaaggagatcgagaagcagaaggtgcacctgaagagcatcaccgaggtgggcgaggccctgaagaccgtgctgggcaagaaggagaccctggtggaggacaagctgagcctgctgaacagcaactggatcgccgtgaccagccgcgccgaggagtggctgaacctgctgctggagtaccagaagcacatggagaccttcgaccagaacgtggaccacatcaccaagtggatcatccaggccgacaccctgctggacgagagcgagaagaagaagccccagcagaaggaggacgtgctgaagcgcctgaaggccgagctgaacgacatccgccccaaggtggacagcacccgcgaccaggccgccaacctgatggccaaccgcggcgaccactgccgcaagctggtggagccccagatcagcgagctgaaccaccgcttcgccgccatcagccaccgcatcaagaccggcaaggccagcatccccctgaaggagctggagcagttcaacagcgacatccagaagctgctggagcccctggaggccgagatccagcagggcgtgaacctgaaggaggaggacttcaacaaggacatgaacgaggacaacgagggcaccgtgaaggagctgctgcagcgcggcgacaacctgcagcagcgcatcaccgacgagcgcaagcgcgaggagatcaagatcaagcagcagctgctgcagaccaagcacaacgccctgaaggacctgcgcagccagcgccgcaagaaggccctggagatcagccaccagtggtaccagtacaagcgccaggccgacgacctgctgaagtgcctggacgacatcgagaagaagctggccagcctgcccgagccccgcgacgagcgcaagatcaaggagatcgaccgcgagctgcagaagaagaaggaggagctgaacgccgtgcgccgccaggccgagggcctgagcgaggacggcgccgccatggccgtggagcccacccagatccagctgagcaagcgctggcgcgagatcgagagcaagttcgcccagttccgccgcctgaacttcgcccagatccacaccgtgcgcgaggagaccatgatggtgatgaccgaggacatgcccctggagatcagctacgtgcccagcacctacctgaccgagatcacccacgtgagccaggccctgctggaggtggagcagctgctgaacgcccccgacctgtgcgccaaggacttcgaggacctgttcaagcaggaggagagcctgaagaacatcaaggacagcctgcagcagagcagcggccgcatcgacatcatccacagcaagaagaccgccgccctgcagagcgccacccccgtggagcgcgtgaagctgcaggaggccctgagccagctggacttccagtgggagaaggtgaacaagatgtacaaggaccgccagggccgcttcgaccgcagcgtggagaagtggcgccgcttccactacgacatcaagatcttcaaccagtggctgaccgaggccgagcagttcctgcgcaagacccagatccccgagaactgggagcacgccaagtacaagtggtacctgaaggagctgcaggacggcatcggccagcgccagaccgtggtgcgcaccctgaacgccaccggcgaggagatcatccagcagagcagcaagaccgacgccagcatcctgcaggagaagctgggcagcctgaacctgcgctggcaggaggtgtgcaagcagctgagcgaccgcaagaagcgcctggaggagcagaagaacatcctgagcgagttccagcgcgacctgaacgagttcgtgctgtggctggaggaggccgacaacatcgccagcatccccctggagcccggcaaggagcagcagctgaaggagaagctggagcaggtgaagctgctggtggaggagctgcccctgcgccagggcatcctgaagcagctgaacgagaccggcggccccgtgctggtgagcgcccccatcagccccgaggagcaggacaagctggagaacaagctgaagcagaccaacctgcagtggatcaaggtgagccgcgccctgcccgagaagcagggcgagatcgaggcccagatcaaggacctgggccagctggagaagaagctggaggacctggaggagcagctgaaccacctgctgctgtggctgagccccatccgcaaccagctggagatctacaaccagcccaaccaggagggccccttcgacgtgaaggagaccgagatcgccgtgcaggccaagcagcccgacgtggaggagatcctgagcaagggccagcacctgtacaaggagaagcccgccacccagcccgtgaagcgcaagctggaggacctgagcagcgagtggaaggccgtgaaccgcctgctgcaggagctgcgcgccaagcagcccgacctggcccccggcctgaccaccatcggcgccagccccacccagaccgtgaccctggtgacccagcccgtggtgaccaaggagaccgccatcagcaagctggagatgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgtgaccctgatcaacttctggcccgtggacagcgcccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccgcaacacccccggcaagcccatgcgcgaggacaccatg

SEQ ID NO: 35574 - DNA, 1851 bp, Artificial Sequence
  Description of Artificial Sequence: Synthetic coding sequence
atgcgcgagcagctgaagggccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgtgaccctgatcaacttctggcccgtggacagcgcccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccgcaacacccccggcaagcccatgcgcgaggacaccatg

SEQ ID NO: 35575 - DNA, 3675 bp, Artificial Sequence
  Description of Artificial Sequence: Synthetic coding sequence
atgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgtgaccctgatcaacttctggcccgtggacagcgcccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccgcaacacccccggcaagcccatgcgcgaggacaccatg

SEQ ID NO: 35576 - DNA, 1905 bp, Artificial Sequence
  Description of Artificial Sequence: Synthetic coding sequence
atgcgcgagcagctgaagggccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgtgaccctgatcaacttctggcccgtggacagcgcccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccacaacgtgggcagcctgttccacatggccgacgacctgggccgcgccatggagagcctggtgagcgtgatgaccgacgaggagggcgccgag

SEQ ID NO: 35577 - DNA, 3729 bp, Artificial Sequence
  Description of Artificial Sequence: Synthetic coding sequence
atgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagacccccgtgaccctgatcaacttctggcccgtggacagcgcccccgccagcagcccccagctgagccacgacgacacccacagccgcatcgagcactacgccagccgcctggccgagatggagaacagcaacggcagctacctgaacgacagcatcagccccaacgagagcatcgacgacgagcacctgctgatccagcactactgccagagcctgaaccaggacagccccctgagccagccccgcagccccgcccagatcctgatcagcctggagagcgaggagcgcggcgagctggagcgcatcctggccgacctggaggaggagaaccgcaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccacaacgtgggcagcctgttccacatggccgacgacctgggccgcgccatggagagcctggtgagcgtgatgaccgacgaggagggcgccgag

SEQ ID NO: 35578 - DNA, 3345 bp, Artificial Sequence
  Description of Artificial Sequence: Synthetic coding sequence
atgcccagcagcctgatgctggaggtgcccgccctggccgacttcaaccgcgcctggaccgagctgaccgactggctgagcctgctggaccaggtgatcaagagccagcgcgtgatggtgggcgacctggaggacatcaacgagatgatcatcaagcagaaggccaccatgcaggacctggagcagcgccgcccccagctggaggagctgatcaccgccgcccagaacctgaagaacaagaccagcaaccaggaggcccgcaccatcatcaccgaccgcatcgagcgcatccagaaccagtgggacgaggtgcaggagcacctgcagaaccgccgccagcagctgaacgagatgctgaaggacagcacccagtggctggaggccaaggaggaggccgagcaggtgctgggccaggcccgcgccaagctggagagctggaaggagggcccctacaccgtggacgccatccagaagaagatcaccgagaccaagcagctggccaaggacctgcgccagtggcagaccaacgtggacgtggccaacgacctggccctgaagctgctgcgcgactacagcgccgacgacacccgcaaggtgcacatgatcaccgagaacatcaacgccagctggcgcagcatccacaagcgcgtgagcgagcgcgaggccgccctggaggagacccaccgcctgctgcagcagttccccctggacctggagaagttcctggcctggctgaccgaggccgagaccaccgccaacgtgctgcaggacgccacccgcaaggagcgcctgctggaggacagcaagggcgtgaaggagctgatgaagcagtggcaggacctgcagggcgagatcgaggcccacaccgacgtgtaccacaacctggacgagaacagccagaagatcctgcgcagcctggagggcagcgacgacgccgtgctgctgcagcgccgcctggacaacatgaacttcaagtggagcgagctgcgcaagaagagcctgaacatccgcagccacctggaggccagcagcgaccagtggaagcgcctgcacctgagcctgcaggagctgctggtgtggctgcagctgaaggacgacgagctgagccgccaggcccccatcggcggcgacttccccgccgtgcagaagcagaacgacgtgcaccgcgccttcaagcgcgagctgaagaccaaggagcccgtgatcatgagcaccctggagaccgtgcgcatcttcctgaccgagcagcccctggagggcctggagaagctgtaccaggagccccgcgagctgccccccgaggagcgcgcccagaacgtgacccgcctgctgcgcaagcaggccgaggaggtgaacaccgagtgggagaagctgaacctgcacagcgccgactggcagcgcaagatcgacgagaccctggagcgcctgcgcgagctgcaggaggccaccgacgagctggacctgaagctgcgccaggccgaggtgatcaagggcagctggcagcccgtgggcgacctgctgatcgacagcctgcaggaccacctggagaaggtgaaggccctgcgcggcgagatcgcccccctgaaggagaacgtgagccacgtgaacgacctggcccgccagctgaccaccctgggcatccagctgagcccctacaacctgagcaccctggaggacctgaacacccgctggaagctgctgcaggtggccgtggaggaccgcgtgcgccagctgcacgaggcccaccgcgacttcggccccgccagccagcacttcctgagcaccagcgtgcagggcccctgggagcgcgccatcagccccaacaaggtgccctactacatcaaccacgagacccagaccacctgctgggaccaccccaagatgaccgagctgtaccagagcctggccgacctgaacaacgtgcgcttcagcgcctaccgcaccgccatgaagctgcgccgcctgcagaaggccctgtgcctggacctgctgagcctgagcgccgcctgcgacgccctggaccagcacaacctgaagcagaacgaccagcccatggacatcctgcagatcatcaactgcctgaccaccatctacgaccgcctggagcaggagcacaacaacctggtgaacgtgcccctgtgcgtggacatgtgcctgaactggctgctgaacgtgtacgacaccggccgcaccggccgcatccgcgtgctgagcttcaagaccggcatcatcagcctgtgcaaggcccacctggaggacaagtaccgctacctgttcaagcaggtggccagcagcaccggcttctgcgaccagcgccgcctgggcctgctgctgcacgacagcatccagatcccccgccagctgggcgaggtggccagcttcggcggcagcaacatcgagcccagcgtgcgcagctgcttccagttcgccaacaacaagcccgagatcgaggccgccctgttcctggactggatgcgcctggagccccagagcatggtgtggctgcccgtgctgcaccgcgtggccgccgccgagaccgccaagcaccaggccaagtgcaacatctgcaaggagtgccccatcatcggcttccgctaccgcagcctgaagcacttcaactacgacatctgccagagctgcttcttcagcggccgcgtggccaagggccacaagatgcactaccccatggtggagtactgcacccccaccaccagcggcgaggacgtgcgcgacttcgccaaggtgctgaagaacaagttccgcaccaagcgctacttcgccaagcacccccgcatgggctacctgcccgtgcagaccgtgctggagggcgacaacatggagaccaacctgcaggccgagtacgaccgcctgaagcagcagcacgagcacaagggcctgagccccctgcccagcccccccgagatgatgcccaccagcccccagagcccccgcgacgccgagctgatcgccgaggccaagctgctgcgccagcacaagggccgcctggaggcccgcatgcagatcctggaggaccacaacaagcagctggagagccagctgcaccgcctgcgccagctgctggagcagccccaggccgaggccaaggtgaacggcaccaccgtgagcagccccagcaccagcctgcagcgcagcgacagcagccagcccatgctgctgcgcgtggtgggcagccagaccagcgacagcatgggcgaggaggacctgctgagccccccccaggacaccagcaccggcctggaggaggtgatggagcagctgaacaacagcttccccagcagccgcggccgcaacacccccggcaagcccatgcgcgaggacaccatg

SEQ ID NO: 35579 - DNA, 1383 bp, Artificial Sequence
  Description of Artificial Sequence: Synthetic coding sequence
atgagccgcatcaacaagaacgtggtgctggccctgctgaccctgaccagcagcgccttcctgctgttccagctgtactactacaagcactacctgagcaccaagaacggcgccggcctgagcaagagcaagggcagccgcatcggcttcgacagcacccagtggcgcgccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgccccgcgacttcaccgccttcgccctgcagtaccacctgtggaagaacgaggagggctggttccgcatcgccgagaacatgggcttccagtgcctgaagatcgagagcaaggacccccgcctggacggcatcgacagcctgagcggcaccgagatccccctgcactacatctgcaagctggccacccacgccatccacctggtggtgttccacgagcgcagcggcaactacctgtggcacggccacctgcgcctgaaggagcacatcgaccgcaagttcgtgcccttccgcaagctgcagttcggccgctaccccggcgccttcgaccgccccgagctgcagcaggtgaccgtggacggcctggaggtgctgatccccaaggaccccatgcacttcgtggaggaggtgccccacagccgcttcatcgagtgccgctacaaggaggcccgcgccttcttccagcagtacctggacgacaacaccgtggaggccgtggccttccgcaagagcgccaaggagctgctgcagctggccgccaagaccctgaacaagctgggcgtgcccttctggctgagcagcggcacctgcctgggctggtaccgccagtgcaacatcatcccctacagcaaggacgtggacctgggcatcttcatccaggactacaagagcgacatcatcctggccttccaggacgccggcctgcccctgaagcacaagttcggcaaggtggaggacagcctggagctgagcttccagggcaaggacgacgtgaagctggacgtgttcttcttctacgaggagaccgaccacatgtggaacggcggcacccaggccaagaccggcaagaagttcaagtacctgttccccaagttcaccctgtgctggaccgagttcgtggacatgaaggtgcacgtgccctgcgagaccctggagtacatcgaggccaactacggcaagacctggaagatccccgtgaagacctgggactggaagcgcagcccccccaacgtgcagcccaacggcatctggcccatcagcgagtgggacgaggtgatccagctgtac

SEQ ID NO: 35580 - DNA, 1290 bp, Artificial Sequence
  Description of Artificial Sequence: Synthetic coding sequence
atgagccgcatcaacaagaacgtggtgctggccctgctgaccctgaccagcagcgccttcctgctgttccagctgtactactacaagcactacctgagcaccaagaacggcgccggcctgagcaagagcaagggcagccgcatcggcttcgacagcacccagtggcgcgccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgccccgcgacttcaccgccttcgccctgcagtaccacctgtggaagaacgaggagggctggttccgcatcgccgagaacatgggcttccagtgcctgaagatcgagagcaaggacccccgcctggacggcatcgacagcctgagcggcaccgagatccccctgcactacatctgcaagctggccacccacgccatccacctggtggtgttccacgagcgcagcggcaactacctgtggcacggccacctgcgcctgaaggagcacatcgaccgcaagttcgtgcccttccgcaagctgcagttcggccgctaccccggcgccttcgaccgccccgagctgcagcaggtgaccgtggacggcctggaggtgctgatccccaaggaccccatgcacttcgtggaggaggtgccccacagccgcttcatcgagtgccgctacaaggaggcccgcgccttcttccagcagtacctggacgacaacaccgtggaggccgtggccttccgcaagagcgccaaggagctgctgcagctggccgccaagaccctgaacaagctgggcgtgcccttctggctgagcagcggcacctgcctgggctggtaccgccagtgcaacatcatcccctacagcaaggacgtggacctgggcatcttcatccaggactacaagagcgacatcatcctggccttccaggacgccggcctgcccctgaagcacaagttcggcaaggtggaggacagcctggagctgagcttccagggcaaggacgacgtgaagctggacgtgttcttcttctacgaggagaccgaccacatgtggaacggcggcacccaggccaagaccggcaagaagttcaagtacctgttccccaagttcaccctgtgctggaccgagttcgtggacatgaaggtgcacgtgccctgcgagaccctggagtacatcgaggccaactacggcaagaaccagcagggcgcc

SEQ ID NO: 35581 - DNA, 705 bp, Artificial Sequence
  Description of Artificial Sequence: Synthetic coding sequence
atgatcctggaggtgggcgagaacaacggcttcttcagcaagagcctgctgccccgctacgccagcaagaagctgaagagcagcctgccccacagccgcgccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgccccgcgacttcaccgccttcgccctgcagtaccacctgtggaagaacgaggagggctggttccgcatcgccgagaacatgggcttccagtgcctgaagatcgagagcaaggacccccgcctggacggcatcgacagcctgagcggcaccgagatccccctgcactacatctgcaagctggccacccacgccatccacctggtggtgttccacgagcgcagcggcaactacctgtggcacggccacctgcgcctgaaggagcacatcgaccgcaagttcgtgcccttccgcaagctgcagttcggccgctaccccggcgccttcgaccgccccgagctgcagcaggtgaccgtggacggcctggaggtgctgatccccaaggaccccatgcacttcgtggaggaggtgccccacagccgcttcatcgagtgccgctacaaggaggcccgcgccttc

SEQ ID NO: 35582 - DNA, 549 bp, Artificial Sequence
  Description of Artificial Sequence: Synthetic coding sequence
atgagccgcatcaacaagaacgtggtgctggccctgctgaccctgaccagcagcgccttcctgctgttccagctgtactactacaagcactacctgagcaccaagaacggcgccggcctgagcaagagcaagggcagccgcatcggcttcgacagcacccagtggcgcgccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgccccgcgacttcaccgccttcgccctgcagtaccacctgtggaagaacgaggagggctggttccgcatcgccgagaacatgggcttccagtgcctgaagatcgagagcaaggacccccgcctggacggcatcgacagcctgagcggcaccgagatccccctgcactacatctgcaagctggccacccacgccatccacctggtggtgttccacgagcgcagcggcaactac

SEQ ID NO: 35583 - DNA, 477 bp, Artificial Sequence
  Description of Artificial Sequence: Synthetic coding sequence
tggtaccgccagtgcaacatcatcccctacagcaaggacgtggacctgggcatcttcatccaggactacaagagcgacatcatcctggccttccaggacgccggcctgcccctgaagcacaagttcggcaaggtggaggacagcctggagctgagcttccagggcaaggacgacgtgaagctggacgtgttcttcttctacgaggagaccgaccacatgtggaacggcggcacccaggccaagaccggcaagaagttcaagtacctgttccccaagttcaccctgtgctggaccgagttcgtggacatgaaggtgcacgtgccctgcgagaccctggagtacatcgaggccaactacggcaaggaggccgagagctacatcctgagcatgctgttccgcaccaccttctggagcctggccgacttccccctgacccccgagaacaacagcagcctgaagaacggcaacctgaacgtg

SEQ ID NO: 35584 - DNA, 813 bp, Artificial Sequence
  Description of Artificial Sequence: Synthetic coding sequence
atgagccgcatcaacaagaacgtggtgctggccctgctgaccctgaccagcagcgccttcctgctgttccagctgtactactacaagcactacctgagcaccaagaacggcgccggcctgagcaagagcaagggcagccgcatcggcttcgacagcacccagtggcgcgccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgccccgcgacttcaccgccttcgccctgcagtaccacctgtggaagaacgaggagggctggttccgcatcgccgagaacatgggcttccagtgcctgaagatcgagagcaaggacccccgcctggacggcatcgacagcctgagcggcaccgagatccccctgcactacatctgcaagctggccacccacgccatccacctggtggtgttccacgagcgcagcggcaactacctgtggcacggccacctgcgcctgaaggagcacatcgaccgcaagttcgtgcccttccgcaagctgcagttcggccgctaccccggcgccttcgaccgccccgagctgcagcaggtgaccgtggacggcctggaggtgctgatccccaaggaccccatgcacttcgtggaggaggtgccccacagccgcttcatcgagtgccgctacaaggaggcccgcgccttcttccagatccccgtgagcgaggtgtacaccgtgctggac

SEQ ID NO: 35585 - DNA, 1485 bp, Artificial Sequence
  Description of Artificial Sequence: Synthetic coding sequence
atgcgcctgacccgctgccaggccgccctggccgccgccatcaccctgaacctgctggtgctgttctacgtgagctggctgcagcaccagccccgcaacagccgcgcccgcggcccccgccgcgccagcgccgccggcccccgcgtgaccgtgctggtgcgcgagttcgaggccttcgacaacgccgtgcccgagctggtggacagcttcctgcagcaggaccccgcccagcccgtggtggtggccgccgacaccctgccctacccccccctggccctgccccgcatccccaacgtgcgcctggccctgctgcagcccgccctggaccgccccgccgccgccagccgccccgagacctacgtggccaccgagttcgtggccctggtgcccgacggcgcccgcgccgaggcccccggcctgctggagcgcatggtggaggccctgcgcgccggcagcgcccgcctggtggccgcccccgtggccaccgccaaccccgcccgctgcctggccctgaacgtgagcctgcgcgagtggaccgcccgctacggcgccgcccccgccgccccccgctgcgacgccctggacggcgacgccgtggtgctgctgcgcgcccgcgacctgttcaacctgagcgcccccctggcccgccccgtgggcaccagcctgttcctgcagaccgccctgcgcggctgggccgtgcagctgctggacctgaccttcgccgccgcccgccagccccccctggccaccgcccacgcccgctggaaggccgagcgcgagggccgcgcccgccgcgccgccctgctgcgcgccctgggcatccgcctggtgagctgggagggcggccgcctggagtggttcggctgcaacaaggagaccacccgctgcttcggcaccgtggtgggcgacacccccgcctacctgtacgaggagcgctggacccccccctgctgcctgcgcgccctgcgcgagaccgcccgctacgtggtgggcgtgctggaggccgccggcgtgcgctactggctggagggcggcagcctgctgggcgccgcccgccacggcgacatcatcccctgggactacgacgtggacctgggcatctacctggaggacgtgggcaactgcgagcagctgcgcggcgccgaggccggcagcgtggtggacgagcgcggcttcgtgtgggagaaggccgtggagggcgacttcttccgcgtgcagtacagcgagagcaaccacctgcacgtggacctgtggcccttctacccccgcaacggcgtgatgaccaaggacacctggctggaccaccgccaggacgtggagttccccgagcacttcctgcagcccctggtgcccctgcccttcgccggcttcgtggcccaggcccccaacaactaccgccgcttcctggagctgaagttcggccccggcgtgatcgagaacccccagtaccccaaccccgccctgctgagcctgaccggcagcggc

SEQ ID NO: 35586 - DNA, 1809 bp, Artificial Sequence
  Description of Artificial Sequence: Synthetic coding sequence
atggccagcgccagcaccagcaagtacaacagccacagcctggagaacgagagcatcaagcgcaccagccgcgacggcgtgaaccgcgacctgaccgaggccgtgccccgcctgcccggcgagaccctgatcaccgacaaggaggtgatctacatctgccccttcaacggccccatcaagggccgcgtgtacatcaccaactaccgcctgtacctgcgcagcctggagaccgacagcagcctgatcctggacgtgcccctgggcgtgatcagccgcatcgagaagatgggcggcgccaccagccgcggcgagaacagctacggcctggacatcacctgcaaggacatgcgcaacctgcgcttcgccctgaagcaggagggccacagccgccgcgacatgttcgagatcctgacccgctacgccttccccctggcccacagcctgcccctgttcgccttcctgaacgaggagaagttcaacgtggacggctggaccgtgtacaaccccgtggaggagtaccgccgccagggcctgcccaaccaccactggcgcatcaccttcatcaacaagtgctacgagctgtgcgacacctaccccgccctgctggtggtgccctaccgcgccagcgacgacgacctgcgccgcgtggccaccttccgcagccgcaaccgcatccccgtgctgagctggatccaccccgagaacaagaccgtgatcgtgcgctgcagccagcccctggtgggcatgagcggcaagcgcaacaaggacgacgagaagtacctggacgtgatccgcgagaccaacaagcagatcagcaagctgaccatctacgacgcccgccccagcgtgaacgccgtggccaacaaggccaccggcggcggctacgagagcgacgacgcctaccacaacgccgagctgttcttcctggacatccacaacatccacgtgatgcgcgagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggaccgcaccgcccagctgaccagcctggccatgctgatgctggacagcttctaccgcagcatcgagggcttcgagatcctggtgcagaaggagtggatcagcttcggccacaagttcgccagccgcatcggccacggcgacaagaaccacaccgacgccgaccgcagccccatcttcctgcagttcatcgactgcgtgtggcagatgagcaagcagttccccaccgccttcgagttcaacgagcagttcctgatcatcatcctggaccacctgtacagctgccgcttcggcaccttcctgttcaactgcgagagcgcccgcgagcgccagaaggtgaccgagcgcaccgtgagcctgtggagcctgatcaacagcaacaaggagaagttcaagaaccccttctacaccaaggagatcaaccgcgtgctgtaccccgtggccagcatgcgccacctggagctgtgggtgaactactacatccgctggaacccccgcatcaagcagcagcagcccaaccccgtggagcagcgctacatggagctgctggccctgcgcgacgagtacatcaagcgcctggaggagctgcagctggccaacagcgccaagctgagcgacccccccaccagccccagcagccccagccagatgatgccccacgtgcagacccacttc

SEQ ID NO: 35587 - DNA, 1698 bp, Artificial Sequence
  Description of Artificial Sequence: Synthetic coding sequence
atggccagcgccagcaccagcaagtacaacagccacagcctggagaacgagagcatcaagcgcaccagccgcgacggcgtgaaccgcgacctgaccgaggccgtgccccgcctgcccggcgagaccctgatcaccgacaaggaggtgatctacatctgccccttcaacggccccatcaagggccgcgtgtacatcaccaactaccgcctgtacctgcgcagcctggagaccgacatgcgcaacctgcgcttcgccctgaagcaggagggccacagccgccgcgacatgttcgagatcctgacccgctacgccttccccctggcccacagcctgcccctgttcgccttcctgaacgaggagaagttcaacgtggacggctggaccgtgtacaaccccgtggaggagtaccgccgccagggcctgcccaaccaccactggcgcatcaccttcatcaacaagtgctacgagctgtgcgacacctaccccgccctgctggtggtgccctaccgcgccagcgacgacgacctgcgccgcgtggccaccttccgcagccgcaaccgcatccccgtgctgagctggatccaccccgagaacaagaccgtgatcgtgcgctgcagccagcccctggtgggcatgagcggcaagcgcaacaaggacgacgagaagtacctggacgtgatccgcgagaccaacaagcagatcagcaagctgaccatctacgacgcccgccccagcgtgaacgccgtggccaacaaggccaccggcggcggctacgagagcgacgacgcctaccacaacgccgagctgttcttcctggacatccacaacatccacgtgatgcgcgagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggaccgcaccgcccagctgaccagcctggccatgctgatgctggacagcttctaccgcagcatcgagggcttcgagatcctggtgcagaaggagtggatcagcttcggccacaagttcgccagccgcatcggccacggcgacaagaaccacaccgacgccgaccgcagccccatcttcctgcagttcatcgactgcgtgtggcagatgagcaagcagttccccaccgccttcgagttcaacgagcagttcctgatcatcatcctggaccacctgtacagctgccgcttcggcaccttcctgttcaactgcgagagcgcccgcgagcgccagaaggtgaccgagcgcaccgtgagcctgtggagcctgatcaacagcaacaaggagaagttcaagaaccccttctacaccaaggagatcaaccgcgtgctgtaccccgtggccagcatgcgccacctggagctgtgggtgaactactacatccgctggaacccccgcatcaagcagcagcagcccaaccccgtggagcagcgctacatggagctgctggccctgcgcgacgagtacatcaagcgcctggaggagctgcagctggccaacagcgccaagctgagcgacccccccaccagccccagcagccccagccagatgatgccccacgtgcagacccacttc

SEQ ID NO: 35588 - DNA, 1248 bp, Artificial Sequence
  Description of Artificial Sequence: Synthetic coding sequence
atgggcggcgccaccagccgcggcgagaacagctacggcctggacatcacctgcaaggacatgcgcaacctgcgcttcgccctgaagcaggagggccacagccgccgcgacatgttcgagatcctgacccgctacgccttccccctggcccacagcctgcccctgttcgccttcctgaacgaggagaagttcaacgtggacggctggaccgtgtacaaccccgtggaggagtaccgccgccagggcctgcccaaccaccactggcgcatcaccttcatcaacaagtgctacgagctgtgcgacacctaccccgccctgctggtggtgccctaccgcgccagcgacgacgacctgcgccgcgtggccaccttccgcagccgcaaccgcatccccgtgctgagctggatccaccccgagaacaagaccgtgatcgtgcgctgcagccagcccctggtgggcatgagcggcaagcgcaacaaggacgacgagaagtacctggacgtgatccgcgagaccaacaagcagatcagcaagctgaccatctacgacgcccgccccagcgtgaacgccgtggccaacaaggccaccggcggcggctacgagagcgacgacgcctaccacaacgccgagctgttcttcctggacatccacaacatccacgtgatgcgcgagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggaccgcaccgcccagctgaccagcctggccatgctgatgctggacagcttctaccgcagcatcgagggcttcgagatcctggtgcagaaggagtggatcagcttcggccacaagttcgccagccgcatcggccacggcgacaagaaccacaccgacgccgaccgcagccccatcttcctgcagttcatcgactgcgtgtggcagatgagcaagcagttccccaccgccttcgagttcaacgagcagttcctgatcatcatcctggaccacctgtacagctgccgcttcggcaccttcctgttcaactgcgagagcgcccgcgagcgccaggccctgcacttcctgagcctgagcctgtgccgccgcctgcagaagggcctgttcctgtacggccac

SEQ ID NO: 35589 - DNA, 1464 bp, Artificial Sequence
  Description of Artificial Sequence: Synthetic coding sequence
atgcgcaacctgcgcttcgccctgaagcaggagggccacagccgccgcgacatgttcgagatcctgacccgctacgccttccccctggcccacagcctgcccctgttcgccttcctgaacgaggagaagttcaacgtggacggctggaccgtgtacaaccccgtggaggagtaccgccgccagggcctgcccaaccaccactggcgcatcaccttcatcaacaagtgctacgagctgtgcgacacctaccccgccctgctggtggtgccctaccgcgccagcgacgacgacctgcgccgcgtggccaccttccgcagccgcaaccgcatccccgtgctgagctggatccaccccgagaacaagaccgtgatcgtgcgctgcagccagcccctggtgggcatgagcggcaagcgcaacaaggacgacgagaagtacctggacgtgatccgcgagaccaacaagcagatcagcaagctgaccatctacgacgcccgccccagcgtgaacgccgtggccaacaaggccaccggcggcggctacgagagcgacgacgcctaccacaacgccgagctgttcttcctggacatccacaacatccacgtgatgcgcgagagcctgaagaaggtgaaggacatcgtgtaccccaacgtggaggagagccactggctgagcagcctggagagcacccactggctggagcacatcaagctggtgctgaccggcgccatccaggtggccgacaaggtgagcagcggcaagagcagcgtgctggtgcactgcagcgacggctgggaccgcaccgcccagctgaccagcctggccatgctgatgctggacagcttctaccgcagcatcgagggcttcgagatcctggtgcagaaggagtggatcagcttcggccacaagttcgccagccgcatcggccacggcgacaagaaccacaccgacgccgaccgcagccccatcttcctgcagttcatcgactgcgtgtggcagatgagcaagcagttccccaccgccttcgagttcaacgagcagttcctgatcatcatcctggaccacctgtacagctgccgcttcggcaccttcctgttcaactgcgagagcgcccgcgagcgccagaaggtgaccgagcgcaccgtgagcctgtggagcctgatcaacagcaacaaggagaagttcaagaaccccttctacaccaaggagatcaaccgcgtgctgtaccccgtggccagcatgcgccacctggagctgtgggtgaactactacatccgctggaacccccgcatcaagcagcagcagcccaaccccgtggagcagcgctacatggagctgctggccctgcgcgacgagtacatcaagcgcctggaggagctgcagctggccaacagcgccaagctgagcgacccccccaccagccccagcagccccagccagatgatgccccacgtgcagacccacttc

SEQ ID NO: 35590 - DNA, 1161 bp, Artificial Sequence
  Description of Artificial Sequence: Synthetic coding sequence
atggccgagaccctgttctggacccccctgctggtggtgctgctggccggcctgggcgacaccgaggcccagcagaccaccctgcaccccctggtgggccgcgtgttcgtgcacaccctggaccacgagaccttcctgagcctgcccgagcacgtggccgtgccccccgccgtgcacatcacctaccacgcccacctgcagggccaccccgacctgccccgctggctgcgctacacccagcgcagcccccaccaccccggcttcctgtacggcagcgccacccccgaggaccgcggcctgcaggtgatcgaggtgaccgcctacaaccgcgacagcttcgacaccacccgccagcgcctggtgctggagatcggcgaccccgagggccccctgctgccctaccaggccgagttcctggtgcgcagccacgacgccgaggaggtgctgcccagcacccccgccagccgcttcctgagcgccctgggcggcctgtgggagcccggcgagctgcagctgctgaacgtgaccagcgccctggaccgcggcggccgcgtgcccctgcccatcgagggccgcaaggagggcgtgtacatcaaggtgggcagcgccagccccttcagcacctgcctgaagatggtggccagccccgacagccacgcccgctgcgcccagggccagccccccctgctgagctgctacgacaccctggccccccacttccgcgtggactggtgcaacgtgaccctggtggacaagagcgtgcccgagcccgccgacgaggtgcccacccccggcgacggcatcctggagcacgaccccttcttctgcccccccaccgaggcccccgaccgcgacttcctggtggacgccctggtgaccctgctggtgcccctgctggtggccctgctgctgaccctgctgctggcctacgtgatgtgctgccgccgcgagggccgcctgaagcgcgacctggccaccagcgacatccagatggtgcaccactgcaccatccacggcaacaccgaggagctgcgccagatggccgccagccgcgaggtgccccgccccctgagcaccctgcccatgttcaacgtgcacaccggcgagcgcctgcccccccgcgtggacagcgcccaggtgcccctgatcctggaccagcac

SEQ ID NO: 35591 - DNA, 789 bp, Artificial Sequence
  Description of Artificial Sequence: Synthetic coding sequence
atggccgagaccctgttctggacccccctgctggtggtgctgctggccggcctgggcgacaccgaggcccagcagaccaccctgcaccccctggtgggccgcgtgttcgtgcacaccctggaccacgagaccttcctgagcctgcccgagcacgtggccgtgccccccgccgtgcacatcacctaccacgcccacctgcagggccaccccgacctgccccgctggctgcgctacacccagcgcagcccccaccaccccggcttcctgtacggcagcgccacccccgaggaccgcggcctgcaggtgatcgaggtgaccgcctacaaccgcgacagcttcgacaccacccgccagcgcctggtgctggagatcggcgaccccgagggccccctgctgccctaccaggccgagttcctggtgcgcagccacgacgccgaggaggtgctgcccagcacccccgccagccgcttcctgagcgccctgggcggcctgtgggagcccggcgagctgcagctgctgaacgtgaccagcgccctggaccgcggcggccgcgtgcccctgcccatcgagggccgcaaggagggcctgaagcgcgacctggccaccagcgacatccagatggtgcaccactgcaccatccacggcaacaccgaggagctgcgccagatggccgccagccgcgaggtgccccgccccctgagcaccctgcccatgttcaacgtgcacaccggcgagcgcctgcccccccgcgtggacagcgcccaggtgcccctgatcctggaccagcac

SEQ ID NO: 35592 - DNA, 534 bp, Artificial Sequence
  Description of Artificial Sequence: Synthetic coding sequence
atgagcgtgaccgcctacaaccgcgacagcttcgacaccacccgccagcgcctggtgctggagatcggcgaccccgagggccccctgctgccctaccaggccgagttcctggtgcgcagccacgacgccgaggaggtgctgcccagcacccccgccagccgcttcctgagcgccctgggcggcctgtgggagcccggcgagctgcagctgctgaacgtgaccagcgccctggaccgcggcggccgcgtgcccctgcccatcgagggccgcaaggagggcgtgtacatcaaggtgggcagcgccagccccttcagcacctgcctgaagatggtggccagccccgacagccacgcccgctgcgcccagggccagccccccctgctgagctgctacgacaccctggccccccacttccgcgtggactggtgcaacgtgaccctggtgcgccgcgaccccggcagcggcggcggcgtgggccacggcccccaccccagcccccccagcctgccctgctgcttcctgagccccagcctg

SEQ ID NO: 35593 - DNA, 789 bp, Artificial Sequence
  Description of Artificial Sequence: Synthetic coding sequence
atggccgagaccctgttctggacccccctgctggtggtgctgctggccggcctgggcgacaccgaggcccagcagaccaccctgcaccccctggtgggccgcgtgttcgtgcacaccctggaccacgagaccttcctgagcctgcccgagcacgtggccgtgccccccgccgtgcacatcacctaccacgcccacctgcagggccaccccgacctgccccgctggctgcgctacacccagcgcagcccccaccaccccggcttcctgtacggcagcgccacccccgaggaccgcggcctgcaggtgatcgaggtgaccgcctacaaccgcgacagcttcgacaccacccgccagcgcctggtgctggagatcggcgaccccgagggccccctgctgccctaccaggccgagttcctggtgcgcagccacgacgccgaggaggtgctgcccagcacccccgccagccgcttcctgagcgccctgggcggcctgtgggagcccggcgagctgcagctgctgaacgtgaccagcgccctggaccgcggcggccgcgtgcccctgcccatcgagggccgcaaggaggtgctgctgcgccacctgggcacccccctgatccagatggtgcaccactgcaccatccacggcaacaccgaggagctgcgccagatggccgccagccgcgaggtgccccgccccctgagcaccctgcccatgttcaacgtgcacaccggcgagcgcctgcccccccgcgtggacagcgcccaggtgcccctgatcctggaccagcac

SEQ ID NO: 35594 - DNA, 954 bp, Artificial Sequence
  Description of Artificial Sequence: Synthetic coding sequence
atggccgccgccgccgccgccgccgccgagcagcagagcagcaacggccccgtgaagaagagcatgcgcgagaaggccgtggagcgccgcagcgtgaacaaggagcacaacagcaacttcaaggccggctacatccccatcgacgaggaccgcctgcacaagaccggcctgcgcggccgcaagggcaacctggccatctgcgtgatcatcctgctgttcatcctggccgtgatcaacctgatcatcaccctggtgatctgggccgtgatccgcatcggccccaacggctgcgacagcatggagttccacgagagcggcctgctgcgcttcaagcaggtgagcgacatgggcgtgatccaccccctgtacaagagcaccgtgggcggccgccgcaacgagaacctggtgatcaccggcaacaaccagcccatcgtgttccagcagggcaccaccaagctgagcgtggagaacaacaagaccagcatcaccagcgacatcggcatgcagttcttcgacccccgcacccagaacatcctgttcagcaccgactacgagacccacgagttccacctgcccagcggcgtgaagagcctgaacgtgcagaaggccagcaccgagcgcatcaccagcaacgccaccagcgacctgaacatcaaggtggacggccgcgccatcgtgcgcggcaacgagggcgtgttcatcatgggcaagaccatcgagttccacatgggcggcaacatggagctgaaggccgagaacagcatcatcctgaacggcagcgtgatggtgagcaccacccgcctgcccagcagcagcagcggcgaccagctgggcagcggcgactgggtgcgctacaagctgtgcatgtgcgccgacggcaccctgttcaaggtgcaggtgaccagccagaacatgggctgccagatcagcgacaacccctgcggcaacacccac

SEQ ID NO: 35595 - DNA, 744 bp, Artificial Sequence
  Description of Artificial Sequence: Synthetic coding sequence
atggccgccgccgccgccgccgccgccgagcagatcaccctggtgatctgggccgtgatccgcatcggccccaacggctgcgacagcatggagttccacgagagcggcctgctgcgcttcaagcaggtgagcgacatgggcgtgatccaccccctgtacaagagcaccgtgggcggccgccgcaacgagaacctggtgatcaccggcaacaaccagcccatcgtgttccagcagggcaccaccaagctgagcgtggagaacaacaagaccagcatcaccagcgacatcggcatgcagttcttcgacccccgcacccagaacatcctgttcagcaccgactacgagacccacgagttccacctgcccagcggcgtgaagagcctgaacgtgcagaaggccagcaccgagcgcatcaccagcaacgccaccagcgacctgaacatcaaggtggacggccgcgccatcgtgcgcggcaacgagggcgtgttcatcatgggcaagaccatcgagttccacatgggcggcaacatggagctgaaggccgagaacagcatcatcctgaacggcagcgtgatggtgagcaccacccgcctgcccagcagcagcagcggcgaccagctgggcagcggcgactgggtgcgctacaagctgtgcatgtgcgccgacggcaccctgttcaaggtgcaggtgaccagccagaacatgggctgccagatcagcgacaacccctgcggcaacacccac

SEQ ID NO: 35596 - DNA, 870 bp, Artificial Sequence
  Description of Artificial Sequence: Synthetic coding sequence
atgatgccccaggagcagtacacccaccaccgcagcaccatgcccggcagcgtgggcccccaggtgtacaaggtgggcatctacggctggcgcaagcgctgcctgtacttcttcgtgctgctgctgatgatcctgatcctggtgaacctggccatgaccatctggatcctgaaggtgatgaacttcaccatcgacggcatgggcaacctgcgcatcaccgagaagggcctgaagctggagggcgacagcgagttcctgcagcccctgtacgccaaggagatccagagccgccccggcaacgccctgtacttcaagagcgcccgcaacgtgaccgtgaacatcctgaacgaccagaccaaggtgctgacccagctgatcaccggccccaaggccgtggaggcctacggcaagaagttcgaggtgaagaccgtgagcggcaagctgctgttcagcgccgacaacaacgaggtggtggtgggcgccgagcgcctgcgcgtgctgggcgccgagggcaccgtgttccccaagagcatcgagacccccaacgtgcgcgccgaccccttcaaggagctgcgcctggagagccccacccgcagcctggtgatggaggcccccaagggcgtggagatcaacgccgaggccggcaacatggaggccacctgccgcaccgagctgcgcctggagagcaaggacggcgagatcaagctggacgccgccaagatccgcctgccccgcctgccccacggcagctacacccccaccggcacccgccagaaggtgttcgagatctgcgtgtgcgccaacggccgcctgttcctgagccaggccggcgccggcagcacctgccagatcaacaccagcgtgtgcctg

SEQ ID NO: 35597 - DNA, 867 bp, Artificial Sequence
  Description of Artificial Sequence: Synthetic coding sequence
atgccccaggagcagtacacccaccaccgcagcaccatgcccggcagcgtgggcccccaggtgtacaaggtgggcatctacggctggcgcaagcgctgcctgtacttcttcgtgctgctgctgatgatcctgatcctggtgaacctggccatgaccatctggatcctgaaggtgatgaacttcaccatcgacggcatgggcaacctgcgcatcaccgagaagggcctgaagctggagggcgacagcgagttcctgcagcccctgtacgccaaggagatccagagccgccccggcaacgccctgtacttcaagagcgcccgcaacgtgaccgtgaacatcctgaacgaccagaccaaggtgctgacccagctgatcaccggccccaaggccgtggaggcctacggcaagaagttcgaggtgaagaccgtgagcggcaagctgctgttcagcgccgacaacaacgaggtggtggtgggcgccgagcgcctgcgcgtgctgggcgccgagggcaccgtgttccccaagagcatcgagacccccaacgtgcgcgccgaccccttcaaggagctgcgcctggagagccccacccgcagcctggtgatggaggcccccaagggcgtggagatcaacgccgaggccggcaacatggaggccacctgccgcaccgagctgcgcctggagagcaaggacggcgagatcaagctggacgccgccaagatccgcctgccccgcctgccccacggcagctacacccccaccggcacccgccagaaggtgttcgagatctgcgtgtgcgccaacggccgcctgttcctgagccaggccggcgccggcagcacctgccagatcaacaccagcgtgtgcctg

SEQ ID NO: 35598 - DNA, 768 bp, Artificial Sequence
  Description of Artificial Sequence: Synthetic coding sequence
atgatgccccaggagcagtacacccaccaccgcagcaccatgcccggcagcgtgggcccccaggtgtacaaggtgggcatctacggctggcgcaagcgctgcctgtacttcttcgtgctgctgctgatgatcctgatcctggtgaacctggccatgaccatctggatcctgaaggtgatgaacttcaccatcgacggcatgggcaacctgcgcatcaccgagaagggcctgaagctggagggcgacagcgagttcctgcagcccctgtacgccaaggagatccagagccgccccggcaacgccctgtacttcaagagcgcccgcaacgtgaccgtgaacatcctgaacgaccagaccaaggtgctgacccagctgatcaccggccccaaggccgtggaggcctacggcaagaagttcgaggtgaagaccgtgagcggcaagctgctgttcagcgccgacaacaacgaggtggtggtgggcgccgagcgcctgcgcgtgctgggcgccgagggcaccgtgttccccaagagcatcgagacccccaacgtgcgcgccgaccccttcaaggagctgcgcctggagagccccacccgcagcctggtgatggaggcccccaagggcgtggagatcaacgccgaggccggcaacatggaggccacctgccgcaccgagctgcgcctggagagcaaggacggcgaggtgcgcgacgagaaggaccgcagcagcaagagctacagcttcaaccgccccaccctgcccatcaccggc

SEQ ID NO: 35599 - DNA, 873 bp, Artificial Sequence
  Description of Artificial Sequence: Synthetic coding sequence
atggtgcgcgagcagtacaccaccgccaccgagggcatctgcatcgagcgccccgagaaccagtacgtgtacaagatcggcatctacggctggcgcaagcgctgcctgtacctgttcgtgctgctgctgctgatcatcctggtggtgaacctggccctgaccatctggatcctgaaggtgatgtggttcagccccgccggcatgggccacctgtgcgtgaccaaggacggcctgcgcctggagggcgagagcgagttcctgttccccctgtacgccaaggagatccacagccgcgtggacagcagcctgctgctgcagagcacccagaacgtgaccgtgaacgcccgcaacagcgagggcgaggtgaccggccgcctgaaggtgggccccaagatggtggaggtgcagaaccagcagttccagatcaacagcaacgacggcaagcccctgttcaccgtggacgagaaggaggtggtggtgggcaccgacaagctgcgcgtgaccggccccgagggcgccctgttcgagcacagcgtggagacccccctggtgcgcgccgaccccttccaggacctgcgcctggagagccccacccgcagcctgagcatggacgccccccgcggcgtgcacatccaggcccacgccggcaagatcgaggccctgagccagatggacatcctgttccacagcagcgacggcatgctggtgctggacgccgagaccgtgtgcctgcccaagctggtgcagggcacctggggccccagcggcagcagccagagcctgtacgagatctgcgtgtgccccgacggcaagctgtacctgagcgtggccggcgtgagcaccacctgccaggagcacaaccacatctgcctg

SEQ ID NO: 35600 - DNA, 786 bp, Artificial Sequence
  Description of Artificial Sequence: Synthetic coding sequence
atggccatgagcagcggcggcagcggcggcggcgtgcccgagcaggaggacagcgtgctgttccgccgcggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagcgcaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagcgcgagacctgcgtggtggtgtacaccggctacggcaaccgcgaggagcagaacctgagcgacctgctgagccccatctgcgaggtggccaacaacatcgagcagaacgcccaggagaacgagaacgagagccaggtgagcaccgacgagagcgagaacagccgcagccccggcaacaagagcgacaacatcaagcccaagagcgccccctggaacagcttcctgcccccccccccccccatgcccggcccccgcctgggccccggcaagatcatccccccccccccccccatctgccccgacagcctggacgacgccgacgccctgggcagcatgctgatcagctggtacatgagcggctaccacaccggctactacatgggcttccgccagaaccagaaggagggccgctgcagccacagcctgaac

SEQ ID NO: 35601 - DNA, 882 bp, Artificial Sequence
  Description of Artificial Sequence: Synthetic coding sequence
atggccatgagcagcggcggcagcggcggcggcgtgcccgagcaggaggacagcgtgctgttccgccgcggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagcgcaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagcgcgagacctgcgtggtggtgtacaccggctacggcaaccgcgaggagcagaacctgagcgacctgctgagccccatctgcgaggtggccaacaacatcgagcagaacgcccaggagaacgagaacgagagccaggtgagcaccgacgagagcgagaacagccgcagccccggcaacaagagcgacaacatcaagcccaagagcgccccctggaacagcttcctgcccccccccccccccatgcccggcccccgcctgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatgggcttccgccagaaccagaaggagggccgctgcagccacagcctgaac

SEQ ID NO: 35602 - DNA, 846 bp, Artificial Sequence
  Description of Artificial Sequence: Synthetic coding sequence
atggccatgagcagcggcggcagcggcggcggcgtgcccgagcaggaggacagcgtgctgttccgccgcggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagcgcaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagcgcgagacctgcgtggtggtgtacaccggctacggcaaccgcgaggagcagaacctgagcgacctgctgagccccatctgcgaggtggccaacaacatcgagcagaacgcccaggagaacgagaacgagagccaggtgagcaccgacgagagcgagaacagccgcagccccggcaacaagagcgacaacatcaagcccaagagcgccccctggaacagcttcctgcccccccccccccccatgcccggcccccgcctgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatggagatgctggcc

SEQ ID NO: 35603 - DNA, 882 bp, Artificial Sequence
  Description of Artificial Sequence: Synthetic coding sequence
atggccatgagcagcggcggcagcggcggcggcgtgcccgagcaggaggacagcgtgctgttccgccgcggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagcgcaagcccgccaagaagaacaagagccagaagaagaacaccgccgccagcctgcagcagtggaaggtgggcgacaagtgcagcgccatctggagcgaggacggctgcatctaccccgccaccatcgccagcatcgacttcaagcgcgagacctgcgtggtggtgtacaccggctacggcaaccgcgaggagcagaacctgagcgacctgctgagccccatctgcgaggtggccaacaacatcgagcagaacgcccaggagaacgagaacgagagccaggtgagcaccgacgagagcgagaacagccgcagccccggcaacaagagcgacaacatcaagcccaagagcgccccctggaacagcttcctgcccccccccccccccatgcccggcccccgcctgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatgaccggcttccactgcgtgagccaggacggcctgaacctgctgaccccc

SEQ ID NO: 35604 - DNA, 681 bp, Artificial Sequence
  Description of Artificial Sequence: Synthetic coding sequence
atggccatgagcagcggcggcagcggcggcggcgtgcccgagcaggaggacagcgtgctgttccgccgcggcaccggccagagcgacgacagcgacatctgggacgacaccgccctgatcaaggcctacgacaaggccgtggccagcttcaagcacgccctgaagaacggcgacatctgcgagaccagcggcaagcccaagaccacccccaagcgcaagcccgccaagaagaacaagagccagaagaagaacaccgccgccagcctgcagcagaacgagaacgagagccaggtgagcaccgacgagagcgagaacagccgcagccccggcaacaagagcgacaacatcaagcccaagagcgccccctggaacagcttcctgcccccccccccccccatgcccggcccccgcctgggccccggcaagcccggcctgaagttcaacggccccccccccccccccccccccccccccccccacctgctgagctgctggctgccccccttccccagcggcccccccatcatccccccccccccccccatctgccccgacagcctggacgacgccgacgccctgggcagcatgctgatcagctggtacatgagcggctaccacaccggctactacatgggcttccgccagaaccagaaggagggccgctgcagccacagcctgaac

SEQ ID NO: 35605 - DNA, 501 bp, Artificial Sequence
  Description of Artificial Sequence: Synthetic coding sequence
atggccaccagcgagctgagctgcgaggtgagcgaggagaactgcgagcgccgcgaggccttctgggccgagtggaaggacctgaccctgagcacccgccccgaggagggctgcagcctgcacgaggaggacacccagcgccacgagacctaccaccagcagggccagtgccaggtgctggtgcagcgcagcccctggctgatgatgcgcatgggcatcctgggccgcggcctgcaggagtaccagctgccctaccagcgcgtgctgcccctgcccatcttcacccccgccaagatgggcgccaccaaggaggagcgcgaggacacccccatccagctgcaggagctgctggccctggagaccgccctgggcggccagtgcgtggaccgccaggaggtggccgagatcaccaagcagctgccccccgtggtgcccgtgagcaagcccggcgccctgcgccgcagcctgagccgcagcatgagccaggaggcccagcgcggc

SEQ ID NO: 35606 - DNA, 1959 bp, Artificial Sequence
  Description of Artificial Sequence: Synthetic coding sequence
atggccgccgccgccgccagccacctgaacctggacgccctgcgcgaggtgctggagtgccccatctgcatggagagcttcaccgaggagcagctgcgccccaagctgctgcactgcggccacaccatctgccgccagtgcctggagaagctgctggccagcagcatcaacggcgtgcgctgccccttctgcagcaagatcacccgcatcaccagcctgacccagctgaccgacaacctgaccgtgctgaagatcatcgacaccgccggcctgagcgaggccgtgggcctgctgatgtgccgcagctgcggccgccgcctgccccgccagttctgccgcagctgcggcctggtgctgtgcgagccctgccgcgaggccgaccaccagccccccggccactgcaccctgcccgtgaaggaggccgccgaggagcgccgccgcgacttcggcgagaagctgacccgcctgcgcgagctgatgggcgagctgcagcgccgcaaggccgccctggagggcgtgagcaaggacctgcaggcccgctacaaggccgtgctgcaggagtacggccacgaggagcgccgcgtgcaggacgagctggcccgcagccgcaagttcttcaccggcagcctggccgaggtggagaagagcaacagccaggtggtggaggagcagagctacctgctgaacatcgccgaggtgcaggccgtgagccgctgcgactacttcctggccaagatcaagcaggccgacgtggccctgctggaggagaccgccgacgaggaggagcccgagctgaccgccagcctgccccgcgagctgaccctgcaggacgtggagctgctgaaggtgggccacgtgggccccctgcagatcggccaggccgtgaagaagccccgcaccgtgaacgtggaggacagctgggccatggaggccaccgccagcgccgccagcaccagcgtgaccttccgcgagatggacatgagccccgaggaggtggtggccagcccccgcgccagccccgccaagcagcgcggccccgaggccgccagcaacatccagcagtgcctgttcctgaagaagatgggcgccaagggcagcacccccggcatgttcaacctgcccgtgagcctgtacgtgaccagccagggcgaggtgctggtggccgaccgcggcaactaccgcatccaggtgttcacccgcaagggcttcctgaaggagatccgccgcagccccagcggcatcgacagcttcgtgctgagcttcctgggcgccgacctgcccaacctgacccccctgagcgtggccatgaactgccagggcctgatcggcgtgaccgacagctacgacaacagcctgaaggtgtacaccctggacggccactgcgtggcctgccaccgcagccagctgagcaagccctggggcatcaccgccctgcccagcggccagttcgtggtgaccgacgtggagggcggcaagctgtggtgcttcaccgtggaccgcggcagcggcgtggtgaagtacagctgcctgtgcagcgccgtgcgccccaagttcgtgacctgcgacgccgagggcaccgtgtacttcacccagggcctgggcctgaacctggagaaccgccagaacgagcaccacctggagggcggcttcagcatcggcagcgtgggccccgacggccagctgggccgccagatcagccacttcttcagcgagaacgaggacttccgctgcatcgccggcatgtgcgtggacgcccgcggcgacctgatcgtggccgacagcagccgcaaggagatcctgcacttccccaagggcggcggctacagcgtgctgatccgcgagggcctgacctgccccgtgggcatcgccctgacccccaagggccagctgctggtgctggactgctgggaccactgcatcaagatctacagctaccacctgcgccgctacagcaccccc

SEQ ID NO: 35607 - DNA, 519 bp, Artificial Sequence
  Description of Artificial Sequence: Synthetic coding sequence
atggccgccgccgccgccagccacctgaacctggacgccctgcgcgaggtgctggagtgccccatctgcatggagagcttcaccgaggagcagctgcgccccaagctgctgcactgcggccacaccatctgccgccagtgcctggagaagctgctggccagcagcatcaacggcgtgcgctgccccttctgcagcaagatcacccgcatcaccagcctgacccagctgaccgacaacctgaccgtgctgaagatcatcgacaccgccggcctgagcgaggccgtgggcctgctgatgtgccgcagctgcggccgccgcctgccccgccagttctgccgcagctgcggcctggtgctgtgcgagccctgccgcgaggccgaccaccagccccccggccactgcaccctgcccgtgaaggaggccgccgaggagcgccgccgcgacttcggcgagaagctgacccgcctgcgcgagctgatgggcgagctgcagcgccgcaaggccgccctggagggcgtg

SEQ ID NO: 35608 - protein, 283 aa, Homo sapiens
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 35609 - protein, 283 aa, Homo sapiens; identical to SEQ ID NO: 35608

SEQ ID NO: 35610 - protein, 283 aa, Homo sapiens; identical to SEQ ID NO: 35608

SEQ ID NO: 35611 - protein, 283 aa, Homo sapiens; identical to SEQ ID NO: 35608

SEQ ID NO: 35612 - protein, 283 aa, Homo sapiens; identical to SEQ ID NO: 35608

SEQ ID NO: 35613 - protein, 283 aa, Homo sapiens; identical to SEQ ID NO: 35608

SEQ ID NO: 35614 - protein, 283 aa, Homo sapiens; identical to SEQ ID NO: 35608

SEQ ID NO: 35615 - protein, 283 aa, Homo sapiens; identical to SEQ ID NO: 35608

SEQ ID NO: 35616 - protein, 283 aa, Homo sapiens; identical to SEQ ID NO: 35608

SEQ ID NO: 35617 - protein, 283 aa, Homo sapiens; identical to SEQ ID NO: 35608

SEQ ID NO: 35618 - protein, 283 aa, Homo sapiens; identical to SEQ ID NO: 35608

SEQ ID NO: 35619 - protein, 283 aa, Homo sapiens; identical to SEQ ID NO: 35608

SEQ ID NO: 35620 - protein, 171 aa, Homo sapiens
MMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 35621 - protein, 283 aa, Homo sapiens; identical to SEQ ID NO: 35608

SEQ ID NO: 35622 - protein, 283 aa, Homo sapiens; identical to SEQ ID NO: 35608

SEQ ID NO: 35623 - protein, 283 aa, Homo sapiens; identical to SEQ ID NO: 35608

SEQ ID NO: 35624 - protein, 283 aa, Homo sapiens; identical to SEQ ID NO: 35608

SEQ ID NO: 35625 - protein, 283 aa, Homo sapiens; identical to SEQ ID NO: 35608

SEQ ID NO: 35626 - protein, 283 aa, Homo sapiens; identical to SEQ ID NO: 35608

SEQ ID NO: 35627 - protein, 283 aa, Homo sapiens; identical to SEQ ID NO: 35608

SEQ ID NO: 35628 - protein, 283 aa, Homo sapiens; identical to SEQ ID NO: 35608

SEQ ID NO: 35629 - protein, 283 aa, Homo sapiens; identical to SEQ ID NO: 35608

SEQ ID NO: 35630 - protein, 283 aa, Homo sapiens; identical to SEQ ID NO: 35608

SEQ ID NO: 35631 - protein, 283 aa, Homo sapiens; identical to SEQ ID NO: 35608

SEQ ID NO: 35632 - protein, 283 aa, Homo sapiens; identical to SEQ ID NO: 35608

SEQ ID NO: 35633 - protein, 283 aa, Homo sapiens; identical to SEQ ID NO: 35608

SEQ ID NO: 35634 - protein, 283 aa, Homo sapiens; identical to SEQ ID NO: 35608

SEQ ID NO: 35635 - protein, 283 aa, Homo sapiens; identical to SEQ ID NO: 35608

SEQ ID NO: 35636 - protein, 283 aa, Homo sapiens; identical to SEQ ID NO: 35608

SEQ ID NO: 35637 - protein, 283 aa, Homo sapiens; identical to SEQ ID NO: 35608

SEQ ID NO: 35638 - protein, 283 aa, Homo sapiens; identical to SEQ ID NO: 35608

SEQ ID NO: 35639 - protein, 283 aa, Homo sapiens; identical to SEQ ID NO: 35608

SEQ ID NO: 35640 - protein, 283 aa, Homo sapiens; identical to SEQ ID NO: 35608

SEQ ID NO: 35641 - protein, 283 aa, Homo sapiens; identical to SEQ ID NO: 35608

SEQ ID NO: 35642 - protein, 283 aa, Homo sapiens; identical to SEQ ID NO: 35608

SEQ ID NO: 35643 - protein, 283 aa, Homo sapiens; identical to SEQ ID NO: 35608

SEQ ID NO: 35644 - protein, 283 aa, Homo sapiens; identical to SEQ ID NO: 35608

SEQ ID NO: 35645 - protein, 283 aa, Homo sapiens; identical to SEQ ID NO: 35608

SEQ ID NO: 35646 - protein, 283 aa, Homo sapiens; identical to SEQ ID NO: 35608

SEQ ID NO: 35647 - protein, 283 aa, Homo sapiens; identical to SEQ ID NO: 35608

SEQ ID NO: 35648 - protein, 283 aa, Homo sapiens; identical to SEQ ID NO: 35608

SEQ ID NO: 35649 - protein, 283 aa, Homo sapiens; identical to SEQ ID NO: 35608

SEQ ID NO: 35650 - protein, 283 aa, Homo sapiens; identical to SEQ ID NO: 35608

SEQ ID NO: 35651 - protein, 91 aa, Homo sapiens
HSASTPILTHSHPAQGMMEVLPGRCVPIAKRELLWAGSAGLACWLAGVIFIDRKRTGDAISVMSEVAQTLLTQDVSHPGLLLQEGASLHLG

SEQ ID NO: 35652 - protein, 91 aa, Homo sapiens; identical to SEQ ID NO: 35651

SEQ ID NO: 35653 - protein, 91 aa, Homo sapiens; identical to SEQ ID NO: 35651

SEQ ID NO: 35654 - protein, 171 aa, Homo sapiens; identical to SEQ ID NO: 35620

SEQ ID NO: 35655 - protein, 171 aa, Homo sapiens; identical to SEQ ID NO: 35620

SEQ ID NO: 35656 - protein, 91 aa, Homo sapiens; identical to SEQ ID NO: 35651

SEQ ID NO: 35657 - protein, 91 aa, Homo sapiens; identical to SEQ ID NO: 35651

SEQ ID NO: 35658 - protein, 91 aa, Homo sapiens; identical to SEQ ID NO: 35651

SEQ ID NO: 35659 - protein, 171 aa, Homo sapiens; identical to SEQ ID NO: 35620

SEQ ID NO: 35660 - protein, 171 aa, Homo sapiens; identical to SEQ ID NO: 35620

SEQ ID NO: 35661 - protein, 91 aa, Homo sapiens; identical to SEQ ID NO: 35651

SEQ ID NO: 35662 - protein, 171 aa, Homo sapiens; identical to SEQ ID NO: 35620

SEQ ID NO: 35663 - protein, 171 aa, Homo sapiens; identical to SEQ ID NO: 35620

SEQ ID NO: 35664 - protein, 246 aa, Homo sapiens
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENVPIVPVVYSSFSSFYNTKKKFFTSGTVTVQVLEAIPTSGLTAADVPALVDTCHRAMRTTFLHISKTPQENGATAGSGVQPAQ

SEQ ID NO: 35665 - protein, 278 aa, Homo sapiens
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENLKVWIYPEGTRNDNGDLLPFKKGAFYLAVQAQVPIVPVVYSSFSSFYNTKKKFFTSGTVTVQVLEAIPTSGLTAADVPALVDTCHRAMRTTFLHISKTPQENGATAGSGVQPAQ

SEQ ID NO: 35666 - protein, 278 aa, Homo sapiens; identical to SEQ ID NO: 35665

SEQ ID NO: 35667 - protein, 456 aa, Homo sapiens
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 35668 - protein, 434 aa, Homo sapiens
MEGAELAGKILSTWLTLVLGFILLPSVFGVSLGISEIYMKILVKTLEWATIRIEKGTPKESILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 35669 - protein, 434 aa, Homo sapiens; identical to SEQ ID NO: 35668

SEQ ID NO: 35670 - protein, 501 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 35671 - protein, 158 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRPPGGSGQVPVFLLQEPSTPQTRECGCPEWWCLALLCSGHGAV

SEQ ID NO: 35672 - protein, 139 aa, Homo sapiens
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHL

SEQ ID NO: 35673 - protein, 77 aa, Homo sapiens
MFTLPQKDFRAPTTCLGPTCMQDLGSSHGEDLEGECSRKLDQKLPELRGVGDPAMISSDTSYLSSRGRMIKWFWDSA

SEQ ID NO: 35674 - protein, 259 aa, Homo sapiens
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIYNDRRYKVCDVPLDQLPRSESLKDVLERLLPYWNERIAPEVLRGKTILISAHGNSSRALLKHLEGISDEDIINITLPTGVPILLELDENLRAVGPHQFLGDQEAIQAAIKKVEDQGKVKQAKK

SEQ ID NO: 35675 - protein, 259 aa, Homo sapiens; identical to SEQ ID NO: 35674

SEQ ID NO: 35676 - protein, 259 aa, Homo sapiens; identical to SEQ ID NO: 35674

SEQ ID NO: 35677 - protein, 78 aa, Homo sapiens
MSKYKLIMLRHGEGAWNKENRFCSWVDQKLNSEGMEEARNCGKQLKALNFEFDLVFTSVLNRSIHTAWLILEELGQEW

SEQ ID NO: 35678 - protein, 297 aa, Homo sapiens
MNRGFSRKSHTFLPKIFFRKMSSSGAKDKPELQFPFLQDEDTVATLLECKTLFILRGLPGSGKSTLARVIVDKYRDGTKMVSADAYKITPGARGALKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 35679 - protein, 401 aa, Homo sapiens
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 35680 - protein, 421 aa, Homo sapiens
MNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 35681 - protein, 57 aa, Homo sapiens
MSSSGAKDKPELQFPFLQDEDTVATLLECKTLFILRGLPGSGKSTLARVIVDKYRDG

SEQ ID NO: 35682 - protein, 335 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 35683 - protein, 326 aa, Homo sapiens
MSGLGKKHLLLMGEFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 35684 - protein, 516 aa, Homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 35685 - protein, 154 aa, Homo sapiens
  MOD_RES (1)..(1): Any amino acid
XSLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 35686 - protein, 475 aa, Homo sapiens
MGAGEQNRQSAHCVQGICGYLEGDEEGEEGEVRSTQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 35687 - protein, 300 aa, Homo sapiens
MGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 35688 - protein, 242 aa, Homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 35689 - protein, 400 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSADDETDDPRRYQKYGYIGTHEYPHFSHRPSTLQAASTPQAEEDWTCTIL

SEQ ID NO: 35690 - protein, 381 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVNLTLVGRRNYIISEHAVNLQQTRGASLSYSFQVA

SEQ ID NO: 35691 - protein, 414 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLTQHTPGSIHPTGRRGLDLHHPLNASASWGKGLQCYLDQFLHFQVGLLIQRGQSSSVSWCIIQDRTQVS

SEQ ID NO: 35692 - protein, 364 aa, Homo sapiens
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVRPPASSLPFIPAPLHEA

SEQ ID NO: 35693 - protein, 719 aa, Homo sapiens
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPTMQTPGSCGARIHPIVNEMFSSRSHRILNNNSKRNF

SEQ ID NO: 35694 - protein, 687 aa, Homo sapiens
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPVKVI

SEQ ID NO: 35695 - protein, 172 aa, Homo sapiens
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSKHCWVSGEKSQRSGCQTALCNL

SEQ ID NO: 35696 - protein, 1087 aa, Homo sapiens
MDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPGLPRAGCSGLGHPIQLDPNQKTPENSKSLNAVYPRAGSKPPSCPAPGPTGAASIVPSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAQLESWWQDQVPSLSLQFPEQNVPEALQFQLVSTALKSWTDVSLLPAFDAVGQLSSGTKPNPQVYSRLLTSGCQEGEHKACFAELRRNFMNIRPVKLKNLILLVKHWYRQVAAQNKGKGPAPASLPPAYALELLTIFAWEQGCRQDCFNMAQGFRTVLGLVQQHQQLCVYWTVNYSTEDPAMRMHLLGQLRKPRPLVLDPADPTWNVGHGSWELLAQEAAALGMQACFLSRDGTSVQPWDVMPALLYQTPAGDLDKFISEFLQPNRQFLAQVNKAVDTICSFLKENCFRNSPIKVIKVVKGGSSAKGTALRGRSDADLVVFLSCFSQFTEQGNKRAEIISEIRAQLEACQQERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQCTKISKGRGSLPPQHGLELLTVYAWEQGGKDSQFNMAEGFRTVLELVTQYRQLCIYWTINYNAKDKTVGDFLKQQLQKPRPIILDPADPTGNLGHNARWDLLAKEAAACTSALCCMGRNGIPIQPWPVKAAV

SEQ ID NO: 35697 - protein, 1086 aa, Homo sapiens
MDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPGLPRAGCSGLGHPIQLDPNQKTPENSKSLNAVYPRAGSKPPSCPAPGPTGQPASSSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAQLESWWQDQVPSLSLQFPEQNVPEALQFQLVSTALKSWTDVSLLPAFDAVGQLSSGTKPNPQVYSRLLTSGCQEGEHKACFAELRRNFMNIRPVKLKNLILLVKHWYRQVAAQNKGKGPAPASLPPAYALELLTIFAWEQGCRQDCFNMAQGFRTVLGLVQQHQQLCVYWTVNYSTEDPAMRMHLLGQLRKPRPLVLDPADPTWNVGHGSWELLAQEAAALGMQACFLSRDGTSVQPWDVMPALLYQTPAGDLDKFISEFLQPNRQFLAQVNKAVDTICSFLKENCFRNSPIKVIKVVKGGSSAKGTALRGRSDADLVVFLSCFSQFTEQGNKRAEIISEIRAQLEACQQERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQCTKISKGRGSLPPQHGLELLTVYAWEQGGKDSQFNMAEGFRTVLELVTQYRQLCIYWTINYNAKDKTVGDFLKQQLQKPRPIILDPADPTGNLGHNARWDLLAKEAAACTSALCCMGRNGIPIQPWPVKAAV

SEQ ID NO: 35698 - protein, 514 aa, Homo sapiens
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGYRWDIVAQRASQCLKQDCCYDNRENPISSWNVKRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPKKQQQLEFQGQVLQDWLGLGIYGIQDSDTLILSKKKGEALFPAS

SEQ ID NO: 35699 - protein, 255 aa, Homo sapiens
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQAHHPGSGRPHPQRGRRVQMGHRCSEGLPVPETGLLL

SEQ ID NO: 35700 - protein, 578 aa, Homo sapiens [sequence omitted]

SEQ ID NO: 35701 - protein, 520 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 35702 - protein, 520 aa, Homo sapiens; identical to SEQ ID NO: 35701

SEQ ID NO: 35703 - protein, 96 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTET

SEQ ID NO: 35704 - protein, 509 aa, Homo sapiens
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 35705 - protein, 508 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 35706 - protein, 466 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 35707 - protein, 386 aa, Homo sapiens
MGQREMWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 35708 - protein, 338 aa, Homo sapiens
MGQREMWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMF

SEQ ID NO: 35709 - protein, 38 aa, Homo sapiens
  MOD_RES (1)..(1): Any amino acid
XLIDKDQSPKWKPADLKEVTEEDLNNHFKSLGSSDLKF

SEQ ID NO: 35710 - protein, 300 aa, Homo sapiens
MGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 35711 - protein, 325 aa, Homo sapiens
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 35712 - protein, 254 aa, Homo sapiens
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 35713 - protein, 166 aa, Homo sapiens
MGTLPKRVKIVEVGPRDGLQNEKNIVSTPVKIKLIDMLSEAGLSVIETTSFVSPKWVPQMGDHTEVLKGIQKFPGINYPVLTPNLKGFEAAMGVSVVDSSVAGLGGCPYAQGASGNLATEDLVYMLEGLGIHTGVNLQKLLEAGNFICQALNRKTSSKVAQATCKL

SEQ ID NO: 35714 - protein, 520 aa, Homo sapiens
MAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 35715 - protein, 334 aa, Homo sapiens
MMVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 35716 - protein, 123 aa, Homo sapiens
MLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 35717 - protein, 123 aa, Homo sapiens; identical to SEQ ID NO: 35716

SEQ ID NO: 35718 - protein, 150 aa, Homo sapiens
SNAYKVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAA

SEQ ID NO: 35719 - protein, 376 aa, Homo sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 35720 - protein, 459 aa, Homo sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVMVAGGTDSCISPLSLAGFSRARALSTNSDPKLACRPFHPKRDGFVMGEGAAVLVLEEYEHAVQRRARIYAEVLGYGLSGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 35721 - protein, 231 aa, Homo sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVM

SEQ ID NO: 35722 - protein, 220 aa, Homo sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSF

SEQ ID NO: 35723 - protein, 624 aa, Homo sapiens
MEIPGSLCKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 35724 - protein, 614 aa, Homo sapiens
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 35725 - protein, 618 aa, Homo sapiens
SGKKQEKEENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDGMFLLDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 35726 - protein, 618 aa, Homo sapiens
MIVLVTEWVDLSLENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 35727 - protein, 619 aa, Homo sapiens
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDGMALPDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 35728 - protein, 500 aa, Homo sapiens
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 35729 - protein, 500 aa, Homo sapiens; identical to SEQ ID NO: 35728

SEQ ID NO: 35730 - protein, 500 aa, Homo sapiens; identical to SEQ ID NO: 35728

SEQ ID NO: 35731 - protein, 153 aa, Homo sapiens
VDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKEETPSWEHILFTCCHNRHLVLPPTRRRLLSWSDNWREILDSKRGAAQRE

SEQ ID NO: 35732 - protein, 201 aa, Homo sapiens
MARSVRVLVDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKYRWVEQHLGPQFVERIILTRDKTVVLGDLLIDDKDTVRGQEETPSWEHILFTCCHNRHLVLPPTRRRLLSWSDNWREILDSKRGAAQRE

SEQ ID NO: 35733 - protein, 228 aa, Homo sapiens
MIRLGGWCARRLCSAAVPAGRRGAAGGLGLAGGRALRVLVDMDGVLADFEGGFLRKFRARFPDQPFIALEDRRGFWVSEQYGRLRPGLSEKAISIWESKNFFFELEPLPGAVEAVKEMASLQNTDVFICTSPIKMFKYCPYEKYAWVEKYFGPDFLEQIVLTRDKTVVSADLLIDDRPDITGAEPTPSWEHVLFTACHNQHLQLQPPRRRLHSWADDWKAILDSKRPC

SEQ ID NO: 35734 - protein, 239 aa, Homo sapiens
MIRLGGWCARRLCSAAVPAGRRGAAGGLGLAGGRALRVLVDMDGVLADFEGGFLRKFRARFPDQPFIALEDRRGFWVSEQYGRLRPGLSEKAISIWESKNFFFELEPLPGAVEAVKEMASLQNTDVFICTSPIKMFKYCPYEKYAWVEKYFGPDFLEQIVLTRDKTVVSADLLIDDRPDITGNQPPAGSMSSSPPATTSTCSCSPPAAGCTRGRTTGRPFWTASGPAELDCASGSSVGL

SEQ ID NO: 35735 - protein, 950 aa, Homo sapiens
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 35736 - protein, 874 aa, Homo sapiens
MMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 35737 - protein, 896 aa, Homo sapiens
MNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 35738 - protein, 592 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 35739 - protein, 533 aa, Homo sapiens
MLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 35740 - protein, 1083 aa, Homo sapiens
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEVTTEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 35741 - protein, 1044 aa, Homo sapiens
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 35742 - protein, 1080 aa, Homo sapiens
MKGTRAIGSVPERSPAGVDLSLTGLPPPVSRRPGSAATTKPIVRSVSVVTGSEQKRKVLEATGPGGSQAINNLRRSNSTTQVSQPRSGSPRPTEPTDFLMLFEGSPSGKKRPASLSTAPSEKGATWNVLDDQPRGFTLPSNARSSSALDSPAGPRRKECTVALAPNFTANNRSNKGAVGNCVTTMVHNRYTPSERAPPLKSSNQTAPSLNNIIKAATCEGSESSGFGKLPKNVSSATHSARNNTGGSTGLPRRKEVTEEEAERFIHQVNQATVTIQRWYRHQVQRRGAGAARLEHLLQAKREEQRQRSGEGTLLDLHQQKEAARRKAREEKARQARRAAIQELQQKRALRAQKASTAERGPPENPRETRVPGMRQPAQELSPTPGGTAHQALKANNTGGGLPAAGPGDRCLPTSDSSPEPQQPPEDRTQDVLAQDAAGDNLEMMAPSRGSAKSRGPLEELLHTLQLLEKEPDVLPRPRTHHRGRYAWASEEDDASSLTADNLEKFGKLSAFPEPPEDGTLLSEAKLQSIMSFLDEMEKSGQDQLDSQQEGWVPEAGPGPLELGSEVSTSVMRLKLEVEEKKQAMLLLQRALAQQRDLTARRVKETEKALSRQLQRQREHYEATIQRHLAFIDQLIEDKKVLSEKCEAVVAELKQEDQRCTERVAQAQAQHELEIKKLKELMSATEKARREKWISEKTKKIKEVTVRGLEPEIQKLIARHKQEVRRLKSLHEAELLQSDERASQRCLRQAEELREQLEREKEALGQQERERARQRFQQHLEQEQWALQQQRQRLYSEVAEERERLGQQAARQRAELEELRQQLEESSSALTRALRAEFEKGREEQERRHQMELNTLKQQLELERQAWEAGRTRKEEAWLLNREQELREEIRKGRDKEIELVIHRLEADMALAKEESEKAAESRIKRLRDKYEAELSELEQSERKLQERCSELKGQLGEAEGENLRLQGLVRQKERALEDAQAVNEQLSSERSNLAQVIRQEFEDRLAASEEETRQAKAELATLQARQQLELEEVHRRVKTALARKEEAVSSLRTQHEAAVKRADHLEELLEQHRRPTPSTK

SEQ ID NO: 35743 - protein, 232 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISRVSVAQPGVQWRNHGIA

SEQ ID NO: 35744 - protein, 215 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSIS

SEQ ID NO: 35745 - protein, 95 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHA

SEQ ID NO: 35746 - protein, 243 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISRQSICSTAWSAVAQSWDSMNFEDCSLFA

SEQ ID NO: 35747 - protein, 243 aa, Homo sapiens; identical to SEQ ID NO: 35746

SEQ ID NO: 35748 - protein, 392 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKTKTLPLPNLPPLHYLDQHNQNCLYKN

SEQ ID NO: 35749 - protein, 422 aa, Homo sapiens
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCKFCRQ

SEQ ID NO: 35750 - protein, 42 aa, Homo sapiens
MDVLSPGQGNNTTSPPAPFETGGNTTGISDVTVSYQVITSLL

SEQ ID NO: 35751 - protein, 390 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 35752 - protein, 377 aa, Homo sapiens
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 35753 - protein, 377 aa, Homo sapiens; identical to SEQ ID NO: 35752

SEQ ID NO: 35754 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 35755 - protein, 365 aa, Homo sapiens; identical to SEQ ID NO: 35754

SEQ ID NO: 35756 - protein, 366 aa, Homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 35757 - protein, 471 aa, Homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 35758 - protein, 471 aa, Homo sapiens; identical to SEQ ID NO: 35757

SEQ ID NO: 35759 - protein, 387 aa, Homo sapiens
MQFLKSAKQKPNYYHIMLVEDQEEGTLHQFNYCERCSESQNNKCISCVDPEDKWYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 35760 - protein, 481 aa, Homo sapiens
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 35761 - protein, 64 aa, Homo sapiens
MVIIPTIGGNTLVILAVSLEKKLQYATNYFLMSLAVADLLVGLFVMPIALLTIMFGIAIPVPIK

SEQ ID NO: 35762 - protein, 458 aa, Homo sapiens
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 35763 - protein, 248 aa, Homo sapiens
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRCISSYPCDWTEGRRKGVREQHDVRAQRPKFRSYWVLRSFLHTADDYGDYVLPDHLRSAPTSFDVTARPHRGTAWTKSGFPEVLQEEYGRGRELCKP

SEQ ID NO: 35764 - protein, 458 aa, Homo sapiens; identical to SEQ ID NO: 35762

SEQ ID NO: 35765 - protein, 279 aa, Homo sapiens
MASMSIVKATSNTISQCGWSASANWTPSISPSMDRGERSPSALSPTQVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 35766 - protein, 454 aa, Homo sapiens
MQKHSPGPPALALLSQSLLTTGNGDTLIINCPGFGQHRVDPAAFQAVFDRKAIGPVTNYSVATHVNISFTLSAIWNCYSRIHTFNCHHARPWHNQFVQWNPDECGGIKKSGMATENLWLSDVFIEESVDQTPAGLMASMSIVKATSNTISQCGWSASANWTPSISPSMDRARAWRRMSRSFQIHHRTSFRTRREWVLLGIQKRTIKVTVATNQYEQAIFHVAIRRRCRPSPYVVNFLVPSGILIAIDALSFYLPLESGNCAPFKMTVLLGYSVFLLMMNDLLPATSTSSHASLVAPLALMQTPLPAGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 35767 - protein, 404 aa, Homo sapiens
MERGWFHGKGFLLGFILHLLLQDSHLQLVTSFLWLNMWNPDECGGIKKSGMATENLWLSDVFIEESVDQTPAGLMASMSIVKATSNTISQCGWSASANWTPSISPSMDRGERSPSALSPTQVTRAWRRMSRSFQIHHRTSFRTRREWVLLGIQKRTIKVTVATNQYEQAIFHVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 35768 - protein, 233 aa, Homo sapiens
MVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 35769 - protein, 447 aa, Homo sapiens
MEGGWPARQSALLCLTVSLLLQGRGDAFTINCSGFDQHGVDPAVFQAVFDRKAFRPFTNYSIPTRVNISFTLSAILGVDAQLQLLTSFLWMDLVWDNPFINWNPKECVGINKLTVLAENLWLPDIFIVESMDVDQTPSGLTAYISSEGRIKYDKPMRVTSICNLDIFYFPFDQQNCTFTFSSFLYTVDSMLLGMDKEVWEITDTSRKVIQTQGEWELLGINKATPKMSMGNNLYDQIMFYVAIRRRPSLYIINLLVPSSFLVAIDALSFYLPAESENRAPFKITLLLGYNVFLLMMNDLLPASGTPLISVYFALCLSLMVVSLLETVFITYLLHVATTQPPPMPRWLHSLLLHCTSPGRCCPTAPQKGNKGLGLTLTHLPGPKEPGELAGKKLGPRETEPDGGSGWTKTQLMELWVQFSHAMDTLLFRLYLLFMASSILTVIVLWNT

SEQ ID NO: 35770 - protein, 471 aa, Homo sapiens
MLAFILSRATPRPALGPLSYREHRVALLHLTHSMSTTGRGVTFTINCSGFGQHGADPTALNSVFNRKPFRPVTNISVPTQVNISFAMSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 35771 - protein, 456 aa, Homo sapiens
MEGSWFHRKRFSFYLLLGFLLQGRGVTFTINCSGFGQHGADPTALNSVFNRKPFRPVTNISVPTQVNISFAMSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 35772 - protein, 441 aa, Homo sapiens
MEGSWFHRKRFSFYLLLGFLLQGRGVTFTINCSGFGQHGADPTALNSVFNRKPFRPVTNISVPTQVNISFAMSAILDVVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 35773 - protein, 456 aa, Homo sapiens
MLAFILSRATPRPALGPLSYREHRVALLHLTHSMSTTGRGVTFTINCSGFGQHGADPTALNSVFNRKPFRPVTNISVPTQVNISFAMSAILDVVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 35774 - protein, 441 aa, Homo sapiens
MLSSVMAPLWACILVAAGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 35775 - protein, 430 aa, Homo sapiens
MIVYFPGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 35776 - protein, 175 aa, Homo sapiens
  MOD_RES (1)..(1): Any amino acid
XAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNGTSSPSAWPSWFSA

SEQ ID NO: 35777 - protein, 482 aa, Homo sapiens
MLAFILSRATPRPALGPLSYREHRVALLHLTHSMSTTGRGVTFTINCSGFGQHGADPTALNSVFNRKPFRPVTNISVPTQVNISFAMSAILDVVWDNPFISWNPEECEGITKMSMAAKNLWLPDIFIIELCVSRAGQREVPSPGSHRDHSLPLGPLMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 35778 - protein, 378 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSGCSPVSSFLLLFCNRPVPV

SEQ ID NO: 35779 - protein, 387 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRYTVLHRGHHQELEKLPIHNDPESLESCF

SEQ ID NO: 35780 - protein, 428 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRTDFLFDRDILARYWTKPARAGPFSGTLSIRCLTARKPVLGDAVECGGQWESQCHPPATSPLVAAQPSDT

SEQ ID NO: 35781 - protein, 402 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLERSLNQGLGQDFHAIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 35782 - protein, 388 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 35783 - protein, 360 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRF

SEQ ID NO: 35784 - protein, 411 aa, Homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSSGTETDRKKLWNKEEKIDQTIQMPKRKRKKKASLSYEDLILLGRKSCFREGK

SEQ ID NO: 35785 - protein, 387 aa, Homo sapiens; identical to SEQ ID NO: 35779

SEQ ID NO: 35786 - protein, 378 aa, Homo sapiens; identical to SEQ ID NO: 35778

SEQ ID NO: 35787 - protein, 378 aa, Homo sapiens; identical to SEQ ID NO: 35778

SEQ ID NO: 35788 - protein, 357 aa, Homo sapiens
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 35789 - protein, 440 aa, Homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 35790 - protein, 445 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 35791 - protein, 479 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLRACTRRVLLRPEKRPPVSVWVLQSPDHHNWLADKMLTTVEKKVMIHD

SEQ ID NO: 35792 - protein, 432 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVL

SEQ ID NO: 35793 - protein, 479 aa, Homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLITRTSGVHQALENFPWGNEVNRWRKSCEYFCTDKMLTTVEKKVMIHD

SEQ ID NO: 35794 - protein, 819 aa, Homo sapiens
GMLDGPSAMTRFCNLIASEPDIAKVPLCIDSSNFAVIEAGLKCCQGKCIVNSISLKEGEATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 35795 - protein, 1265 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 35796 - protein, 1118 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKCMSVYRKIGE

SEQ ID NO: 35797 - protein, 229 aa, Homo sapiens
MSAGLRAGCHVVLLCRFSLGSFSVPSRDSASGRACLAARPTPRTGRVPGKKARAPAVAAPSPERGPRALRAFGVRSPPATRANGRRQKTRALCGRLAWRWLAWPLAVVTCGEHVFSAAPSAQGGDSTTCHPRSKTCRNPEYLLAGADIIETNTFSSTSIAQADYGLEHLAYRMNMCSAGVARKAAEEVTLQTGIKRFVAGALGPTNKTLSVSPSVERPDYRNINLPVGS

SEQ ID NO: 35798 - protein, 1214 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 35799 - protein, 725 aa, Homo sapiens
MGAASVRAGARLVEVALCSFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 35800 - protein, 58 aa, Homo sapiens
MRRFLLLYATQQGQAKAIAEEICEQAVVHGFSADLHCISESDKVSVIQNTPTFAMGGR

SEQ ID NO: 35801 - protein, 698 aa, Homo sapiens
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 35802 - protein, 156 aa, Homo sapiens
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRS

SEQ ID NO: 35803 - protein, 41 aa, Homo sapiens
MRRFLLLYATQQGQAKAIAEEICEQAVVHGFSADLHCISES

SEQ ID NO: 35804 - protein, 112 aa, Homo sapiens
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIID

SEQ ID NO: 35805 - protein, 82 aa, Homo sapiens
MLWDPALPRLAVYASCLFFSCLDAHEGPVHGPRGRGEGGRGSERQRVRPGGGGGAGSVHIHLEEEDGAEDQDHRDEDWITKK

SEQ ID NO: 35806 - protein, 548 aa, Homo sapiens
MTMAAAAVVARGAGARAATAAALRGGCGTAARGRPCAGPARPLCTAPGTAPDMKRYLWERYREAKRSTEELVPSIMSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 35807 - protein, 561 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 35808 - protein, 199 aa, Homo sapiens
MDYTLAVYKSPEYESLGFELTVERLVSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDSKSSRIQYFLKVLW

SEQ ID NO: 35809 - protein, 561 aa, Homo sapiens; identical to SEQ ID NO: 35807

SEQ ID NO: 35810 - protein, 147 aa, Homo sapiens [sequence omitted]

SEQ ID NO: 35811 - protein, 532 aa, Homo sapiens
MSKEGVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 35812 - protein, 265 aa, Homo sapiens
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTD

SEQ ID NO: 35813 - protein, 174 aa, Homo sapiens
VSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDSKSSRIQYFLKVLW

SEQ ID NO: 35814 - protein, 336 aa, Homo sapiens
MRAPSMDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 35815 - protein, 285 aa, Homo sapiens
MPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 35816 - protein, 297 aa, Homo sapiens
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 35817 - protein, 297 aa, Homo sapiens; identical to SEQ ID NO: 35816

SEQ ID NO: 35818 - protein, 285 aa, Homo sapiens; identical to SEQ ID NO: 35815

SEQ ID NO: 35819 - protein, 42 aa, Homo sapiens
MPEFQKSSVRIKNPTRVEEIICGLIKGGAAKLQIITDFDMTL

SEQ ID NO: 35820 - protein, 574 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 35821 - protein, 264 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNCFKRIAWARMSR

SEQ ID NO: 35822 - protein, 259 aa, Homo sapiens
MDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGDLKECCPICINQDDSWKEQPTAQTYLNTWF

SEQ ID NO: 35823 - protein, 524 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 35824 - protein, 230 aa, Homo sapiens
  MOD_RES (1)..(1): Any amino acid
XDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDEL

SEQ ID NO: 35825 - protein, 179 aa, Homo sapiens
  MOD_RES (1)..(1): Any amino acid
XNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGDLKECCPICINQDDSWKEQPTAQTYLNTWF

SEQ ID NO: 35826 - protein, 228 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKLRSSSLGKWCAFLVSSFQFCSGSTKNSWSHIYTLWFPPSLVVYGLRKQYKNPMIQTKAK

SEQ ID NO: 35827 - protein, 271 aa, Homo sapiens
MSPEMGELTQTRLQKIWIPHSSGSSRLQRRRGSSIPQFTNSPTMVIMVGLPARGKTYISTKLTRYLNWIGTPTKDNMEALQIRKQCALAALKDVHNYLSHEEGHVAVFDATNTTRERRSLILQFAKEHGYKGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 35828 - protein, 471 aa, Homo sapiens
MSPEMGELTQTRLQKIWIPHSSGSSRLQRRRGSSIPQFTNSPTMVIMVGLPARGKTYISTKLTRYLNWIGTPTKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 35829 - protein, 406 aa, Homo sapiens
MEEKTSRIKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 35830 - protein, 471 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTAAETTLAVRRRPSAASLMLPC

SEQ ID NO: 35831 - protein, 505 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTNNFPKNQTPVRMRRNSFTPLSSSNTIRRPRNYSVGSRPLKPLSPLRAQDMQEGAD

SEQ ID NO: 35832 - protein, 373 aa, Homo sapiens
MKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTAAETTLAVRRRPSAASLMLPC

SEQ ID NO: 35833 - protein, 264 aa, Homo sapiens
MEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGAGCKVETIKLNVEAVNTHRDKPTAAETTLAVRRRPSAASLMLPC

SEQ ID NO: 35834 - protein, 472 aa, Homo sapiens
MTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTNNFPKNQTPVRMRRNSFTPLSSSNTIRRPRNYSVGSRPLKPLSPLRAQDMQEGAD

SEQ ID NO: 35835 - protein, 513 aa, Homo sapiens
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACL

SEQ ID NO: 35836 - protein, 514 aa, Homo sapiens
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLT

SEQ ID NO: 35837 - protein, 514 aa, Homo sapiens; identical to SEQ ID NO: 35836

SEQ ID NO: 35838 - protein, 520 aa, Homo sapiens
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 35839 - protein, 117 aa, Homo sapiens
MPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLNWKGVMRNAA

SEQ ID NO: 35840 - protein, 526 aa, Homo sapiens
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLRTVCHIFSKFSPY

SEQ ID NO: 35841 - protein, 188 aa, Homo sapiens
MNIHVQPRTIYLCRHGENEHNLQGRIGGDSGLSSRGKKFASALSKFVEEQNLKDLRVWTSQLKSTIQTAEALRLPYEQWKALNEIDASYQDLVQRLEPVIMELERQENVLVICHQAVLRCLLAYFLDKSAEEMPYLKCPLHTVLKLTPVAYGCRVESIYLNVESVCTHRERSENMKGSRSSADSSRKH

SEQ ID NO: 35842 - protein, 526 aa, Homo sapiens; identical to SEQ ID NO: 35840

SEQ ID NO: 35843 - protein, 500 aa, Homo sapiens
MPFRKACGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 35844 - protein, 92 aa, Homo sapiens
IYLNVESVCTHRERSEDAKKGPNPLMRRNSVTPLASPEPTKKPRINSFEEHVASTSAALPSCLPPEVPTQLPGQPLLGQACLNWKGVMRNAA

SEQ ID NO: 35845 - protein, 31 aa, Homo sapiens
IYLNVESVCTHRERSENMKGSRSSADSSRKH

SEQ ID NO: 35846 - protein, 86 aa, Homo sapiens
MPYLKCPLHTVLKLTPVAYGCRVESIYLNVESVCTHRERSEGLSLFPRLECGGAVTAHCSLNLLGSSDPPASASRVAETTGCKEGT

SEQ ID NO: 35847 - protein, 143 aa, Homo sapiens
  MOD_RES (1)..(1): Any amino acid
XVEEQNLKDLRVWTSQLKSTIQTAEALRLPYEQWKALNEIDASYQDLVQRLEPVIMELERQENVLVICHQAVLRCLLAYFLDKSAEEMPYLKCPLHTVLKLTPVAYGCRVESIYLNVESVCTHRERSENMKGSRSSADSSRKH

SEQ ID NO: 35848 - protein, 184 aa, Homo sapiens
MPFRKACGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMQKAFQRDLSATPLWCCRKLKSPARITKTATRQKPWTTS

SEQ ID NO: 35849 - protein, 534 aa, Homo sapiens
MGEGGQKEGDSQQAGALPLLCQLDTFSPKATVFGVSINPACGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 35850 - protein, 469 aa, Homo sapiens
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 35851 - protein, 175 aa, Homo sapiens
MTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDL

SEQ ID NO: 35852 - protein, 458 aa, Homo sapiens
MDRGSLGGSSLTDLGPGSSRRVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 35853 - protein, 435 aa, Homo sapiens
MTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 35854 - protein, 142 aa, Homo sapiens
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKFLMPQTPPENGERPSLILENRMATRPFLSSPSVWILRS

SEQ ID NO: 35855 - protein, 258 aa, Homo sapiens
MAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKRILEDQEENPLPAALVQPHTGKLCWFLDEAAARLLTVPFEKHSTL

SEQ ID NO: 35856 - protein, 475 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 35857 - protein, 475 aa, Homo sapiens; identical to SEQ ID NO: 35856

SEQ ID NO: 35858 - protein, 108 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQV

SEQ ID NO: 35859 - protein, 164 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHL

SEQ ID NO: 35860 - protein, 91 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPP

SEQ ID NO: 35861 - protein, 105 aa, Homo sapiens
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVT

SEQ ID NO: 35862 - protein, 281 aa, Homo sapiens
MDSYSTYLATVKVSGSWLEEQDEDIYEVESRVPLPHPFPLCEHLDENNSVIVNTSIFHFIHKRNGHILKLISKISLPTPPYSLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMR

SEQ ID NO: 35863 - protein, 3907 aa, Homo sapiens
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 35864 - protein, 3857 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 35865 - protein, 3911 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEVFGFYNMCFSTLCDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 35866 - protein, 1643 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQVRVL

SEQ ID NO: 35867 - protein, 3876 aa, Homo sapiens
MEDEERQKKLEAGKAKIEELSLAFLVRQLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDP

SEQ ID NO: 35868 - protein, 593 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFFEC

SEQ ID NO: 35869 - protein, 903 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 35870 - protein, 945 aa, Homo sapiens
MGALGVSGSSSPGGCPGWRRLPAAVNTNPVDFAPGVITQASRMAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 35871 - protein, 903 aa, Homo sapiens; identical to SEQ ID NO: 35869

SEQ ID NO: 35872 - protein, 662 aa, Homo sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 35873 - protein, 604 aa, Homo sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKV

SEQ ID NO: 35874 - protein, 2817 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 35875 - protein, 1058 aa, Homo sapiens
MSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 35876 - protein, 2816 aa, Homo sapiens
KLLEKQPPIEGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 35877 - protein, 2813 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 35878 - protein, 414 aa, Homo sapiens
MSNTWKFLSHSTDSLNKISKVNESTESLTDEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINT

SEQ ID NO: 35879 - protein, 385 aa, Homo sapiens
MYERHKRRYSLCDISKVDRTVDVVLLKINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSK

SEQ ID NO: 35880 - protein, 2792 aa, Homo sapiens
KLLEKQPPIEGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 35881 - protein, 1745 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSK

SEQ ID NO: 35882 - protein, 275 aa, Homo sapiens
PSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGL

SEQ ID NO: 35883 - protein, 38 aa, Homo sapiens
MKLNPQQAPLYGDCVVTVLLAEEDKAEDDVVFYLVFLG

SEQ ID NO: 35884 - protein, 179 aa, Homo sapiens
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHGENLYDLQTHFKFVIFLLFF

SEQ ID NO: 35885 - protein, 137 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSDAPIVVSYVGDHQALVHRPGMVRFRENWQKNLTDAKYSFMESFPFLFNRV

SEQ ID NO: 35886 - protein, 89 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSVS

SEQ ID NO: 35887 - protein, 138 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSPDAPIVVSYVGDHQALVHRPGMVRFRENWQKNLTDAKYSFMESFPFLFNRV

SEQ ID NO: 35888 - protein, 137 aa, Homo sapiens; identical to SEQ ID NO: 35885

SEQ ID NO: 35889 - protein, 197 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSKCVSKKCWAHGVEFVERKDLIHSFLYIYYVHWSISTADLPVARISAGTYFTMKVSKTKPPDAPIVVSYVGDHQALVHRPGMVRFRENWQKNLTDAKYSFMESFPFLFNRV

SEQ ID NO: 35890 - protein, 89 aa, Homo sapiens; identical to SEQ ID NO: 35886

SEQ ID NO: 35891 - protein, 695 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKAVKLREQEQKEEKLRLQQQEERRRLQEAELRRVEEEKERALGLQRKERELRERLLSILLSKKPDDSHTHDELGVAHADLLQPVLDILQTVSSGCVSATTLHPLGGQPPAGAPKESPAHPEADGAPKSVNGSVAEEAPCKEVQSSCRVVPEDGSPEKRCPGGVLSCIPDNNQQPKGIPACEQNVSRKDTRSEQDKCNREPSKGRGRATGDGLADRHKRERSRARRASSREDGRPRKERRPHKKHAYKDDSPRRRSTSPDHTRSRRSHSKDRHRRERSRERRGSASRKHSRHRRRSERSRSRSPSRHRSTWNR

SEQ ID NO: 35892 - protein, 446 aa, Homo sapiens
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKVPGGSLCSRQPRPGCPQCPPLKCGRRHGAVSPPAAAVATKPALMPRMTAPSREGVALVCRSR

SEQ ID NO: 35893 - protein, 859 aa, Homo sapiens
MEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 35894 - protein, 948 aa, Homo sapiens
MRWPQPGAAARLPPESPGPPESPGPPEREAAAARRWTGAEPQDCAPGSGRPEKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 35895 - protein, 1090 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 35896 - protein, 1103 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAGVGWENVLLKEGESASNATETSGPDMTIKKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 35897 - protein, 961 aa, Homo sapiens
MRWPQPGAAARLPPESPGPPESPGPPEREAAAARRWTGAEPQDCAPGSGRPEKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 35898 - protein, 854 aa, Homo sapiens
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 35899 - protein, 845 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 35900 - protein, 471 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQNTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 35901 - protein, 845 aa, Homo sapiens; identical to SEQ ID NO: 35899

SEQ ID NO: 35902 - protein, 254 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISP

SEQ ID NO: 35903 - protein, 213 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQNTCEEDCPGSTMGYMAQSTQYEKCGGGQSAKAL

SEQ ID NO: 35904 - protein, 183 aa, Homo sapiens
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 35905 - protein, 183 aa, Homo sapiens
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQAENISKDLYIEVYPGTYSVTVGSNDLTKKTHVVAVDSGQSVDLVFPV

SEQ ID NO: 35906 - protein, 210 aa, Homo sapiens
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 35907 - protein, 183 aa, Homo sapiens; identical to SEQ ID NO: 35904

SEQ ID NO: 35908 - protein, 210 aa, Homo sapiens; identical to SEQ ID NO: 35906

SEQ ID NO: 35909 - protein, 492 aa, Homo sapiens
MGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35910 - protein, 572 aa, Homo sapiens
MAAILGDTIMVAKGLVKLTQAAVETHLQHLGIGGELIMGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35911 - protein, 647 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35912 - protein, 595 aa, Homo sapiens
MFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35913 - protein, 647 aa, Homo sapiens; identical to SEQ ID NO: 35911

SEQ ID NO: 35914 - protein, 598 aa, Homo sapiens
MAARALQSTAVEQIGMFLGKVQGQDKHEEYFAENFGGPEGEFHFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35915 - protein, 321 aa, Homo sapiens
MLSIQDDAFINPHLAKIFERVRQSADFMPLKQMMYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35916 - protein, 368 aa, Homo sapiens
MLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 35917 - protein, 1196 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 35918 - protein, 1053 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTDSHFAEFNTCILWWKKH

SEQ ID NO: 35919 - protein, 54 aa, Homo sapiens
MPTAESEAKVKTKVRFEELLKTHSDLMREKKKLKKKLVRSEENISNQEKSMAVW

SEQ ID NO: 35920 - protein, 1196 aa, Homo sapiens; identical to SEQ ID NO: 35917

SEQ ID NO: 35921 - protein, 1053 aa, Homo sapiens
MPTTESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTDSHFAEFNTCILWWKKH

SEQ ID NO: 35922 - protein, 498 aa, Homo sapiens
MRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKVK

SEQ ID NO: 35923 - protein, 1196 aa, Homo sapiens; identical to SEQ ID NO: 35917

SEQ ID NO: 35924 - protein, 405 aa, Homo sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQDTYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 35925 - protein, 398 aa, Homo sapiens
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 35926 - protein, 404 aa, Homo sapiens
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILRPQQGPGSSPDPSMWSELV

SEQ ID NO: 35927 - protein, 187 aa, Homo sapiens
MSGGGHGGVCFLCCILLQGRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIK

SEQ ID NO: 35928 - protein, 360 aa, Homo sapiens
MRKRTEPVALEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 35929 - protein, 339 aa, Homo sapiens
MLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 35930 - protein, 558 aa, Homo sapiens
MAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 35931 - protein, 601 aa, Homo sapiens
MSQLARRRSRYGLTSRAHNTSEAGRAGPAGGPAAGRAAARAGAMAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 35932 - protein, 264 aa, Homo sapiens
MPPPALFLSSLYPRLEFQNDFYRSCIRRSSPQPPPNLAWRPESLYSGELAGGGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCV

SEQ ID NO: 35933 - protein, 264 aa, Homo sapiens; identical to SEQ ID NO: 35932

SEQ ID NO: 35934 - protein, 264 aa, Homo sapiens; identical to SEQ ID NO: 35932

SEQ ID NO: 35935 - protein, 601 aa, Homo sapiens; identical to SEQ ID NO: 35931

SEQ ID NO: 35936 - protein, 264 aa, Homo sapiens; identical to SEQ ID NO: 35932

SEQ ID NO: 35937 - protein, 601 aa, Homo sapiens; identical to SEQ ID NO: 35931

SEQ ID NO: 35938 - protein, 264 aa, Homo sapiens; identical to SEQ ID NO: 35932

SEQ ID NO: 35939 - protein, 601 aa, Homo sapiens; identical to SEQ ID NO: 35931

SEQ ID NO: 35940 - protein, 264 aa, Homo sapiens; identical to SEQ ID NO: 35932

SEQ ID NO: 35941 - protein, 558 aa, Homo sapiens; identical to SEQ ID NO: 35930

SEQ ID NO: 35942 - protein, 601 aa, Homo sapiens; identical to SEQ ID NO: 35931

SEQ ID NO: 35943 - protein, 145 aa, Homo sapiens
MLGHCCYFWQVWPASEALAAGPTPSTGSSSPSWKQHIGTSLQKTRGSLPTTTLTSGAGQSTSTGKNPAAGRSLEGALPAGVWPCFAQSPCTGGQQTPSSTGLRSCLVRSPGGKQQRGEAHWGGGAISGVLWEWALHCKIAVTHWA

SEQ ID NO: 35944 - protein, 558 aa, Homo sapiens; identical to SEQ ID NO: 35930

SEQ ID NO: 35945 - protein, 558 aa, Homo sapiens; identical to SEQ ID NO: 35930

SEQ ID NO: 35946 - protein, 558 aa, Homo sapiens; identical to SEQ ID NO: 35930

SEQ ID NO: 35947 - protein, 145 aa, Homo sapiens; identical to SEQ ID NO: 35943

SEQ ID NO: 35948 - protein, 145 aa, Homo sapiens; identical to SEQ ID NO: 35943

SEQ ID NO: 35949 - protein, 145 aa, Homo sapiens; identical to SEQ ID NO: 35943

SEQ ID NO: 35950 - protein, 525 aa, Homo sapiens
MPPPALFLSSLYPRLEFQNDFYRSCIRRSSPQPPPNLAWRPESLYSGELAGGGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 35951 - protein, 558 aa, Homo sapiens; identical to SEQ ID NO: 35930

SEQ ID NO: 35952 - protein, 525 aa, Homo sapiens; identical to SEQ ID NO: 35950

SEQ ID NO: 35953 - protein, 525 aa, Homo sapiens; identical to SEQ ID NO: 35950

SEQ ID NO: 35954 - protein, 145 aa, Homo sapiens; identical to SEQ ID NO: 35943

SEQ ID NO: 35955 - protein, 525 aa, Homo sapiens; identical to SEQ ID NO: 35950

SEQ ID NO: 35956 - protein, 558 aa, Homo sapiens; identical to SEQ ID NO: 35930

SEQ ID NO: 35957 - protein, 525 aa, Homo sapiens; identical to SEQ ID NO: 35950

SEQ ID NO: 35958 - protein, 145 aa, Homo sapiens; identical to SEQ ID NO: 35943

SEQ ID NO: 35959 - protein, 525 aa, Homo sapiens; identical to SEQ ID NO: 35950

SEQ ID NO: 35960 - protein, 145 aa, Homo sapiens; identical to SEQ ID NO: 35943

SEQ ID NO: 35961 - protein, 525 aa, Homo sapiens; identical to SEQ ID NO: 35950

SEQ ID NO: 35962 - protein, 425 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 35963 - protein, 425 aa, Homo sapiens; identical to SEQ ID NO: 35962

SEQ ID NO: 35964 - protein, 409 aa, Homo sapiens
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGGMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 35965 - protein, 349 aa, Homo sapiens
MAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 35966 - protein, 496 aa, Homo sapiens
MAELQMLLEEEIPSGKRALIESYQNLTRVADYCENNYIQRHGFAVLLCLLSNSWPQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35967 - protein, 509 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKKWHKIIHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35968 - protein, 480 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35969 - protein, 482 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKKWHKIIHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35970 - protein, 423 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKKWHKIIHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVSIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35971 - protein, 452 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35972 - protein, 476 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35973 - protein, 481 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35974 - protein, 508 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35975 - protein, 475 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35976 - protein, 446 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35977 - protein, 451 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPAPGSAPGSQYGTMTRQISRHNSTTSSTSSGGYRRTPSVTAQFSAQPHVNGGPLYSQNSIADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35978 - protein, 329 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35979 - protein, 394 aa, Homo sapiens
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKKWHKIIHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPVADSPTPPPPPPPDDIPMFDDSPPPPPPPPVDYEDEEAAVVQYNDPYADGDPAWAPKNYIEKVVAIYDYTKDKDDELSFMEGAIIYVIKKNDDGWYEGVCNRVTGLFPGNYVESIMHYTD

SEQ ID NO: 35980 - protein, 1330 aa, Homo sapiens
MPLSPPAQGDPGEPSPCRPPKKHTTFHLWRSKKKQQPAPPDCGVFVPHPLPAPAGEARALDVVDGKYVVRDSQEFPLHCGESQFFHTTSEALGSLLLESGIFKKSRAQPPEDNRRKPVLGKLGTLFTAGRRRNSRNGLESPTRSNAKPLSPKDVVASPKLPERESERSRSQSSQLKQTDTSEEGSPRENPREAEGELPESGGPAAPPDAELSPRWSSSAAAVAVQQCHENDSPQLEPLEAEGEPFPDATTTAKQLHSSPGNSSRQENAETPARSPGEDASPGAGHEQEAFLGVRGAPGSPTQERPAGGLGEAPNGAPSVCAEEGSLGPRNARSQPPKGASDLPGEPPAEGAAHTASSAQADCTARPKGHAHPAKVLTLDIYLSKTEGAQVDEPVVITPRAEDCGDWDDMEKRSSGRRSGRRRGSQKSTDSPGADAELPESAARDDAVFDDEVAPNAASDNASAEKKVKSPRAALDGGVASAASPESKPSPGTKGQLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHM

SEQ ID NO: 35981 - protein, 1723 aa, Homo sapiens
MEKRSSGRRSGRRRGSQKSTDSPGADAELPESAARDDAVFDDEVAPNAASDNASAEKKVKSPRAALDGGVASAASPESKPSPGTKGQLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYPQKEKTKEDLDSRSNLHLPETKFSELSKLKNDDMEKANHIESVIKSNLPNCANSDTDFMGLFKSSRYDPSISFSGMSLSDTMTLRGSVQNKLNPRPGKVVIYSEPDVSEKCIEVFSDIQDCSSWSLSPVILIKVVRGCWILYEQPNFEGHSIPLEEGELELSGLWGIEDILERHEEAESDKPVVIGSIRHVVQDYRVSHIDLFTEPEGLGILSSYFDDTEEMQGFGVMQKTCSMKVHWGTWLIYEEPGFQGVPFILEPGEYPDLSFWDTEEAYIGSMRPLKMGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 35982 - protein, 316 aa, Homo sapiens
MQKPKTVAWENLGPEMSALGTAFSREGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDV

SEQ ID NO: 35983 - protein, 542 aa, Homo sapiens
MQKPKTVAWENLGPEMSALGTAFSREGGRKVEFPTDPKVVVYEKPFFEGKCVELETGMCSFVMEGGETEEATGDDHLPFTSVGSMKVLRGIWVAYEKPGFTGHQYLLEEGEYRDWKAWGGYNGELQSLRPILGDFSNAHMIMYSEKNFGSKGSSIDVLGIVANLKETGYGVKTQSINVLSGVWVAYENPDFTGEQYILDKGFYTSFEDWGGKNCKISSVQPICLDSFTGPRRRNQIHLFSEPQFQGHSQSFEETTSQIDDSFSTKSCRVSGGSWVVYDGENFTGNQYVLEEGHYPCLSAMGCPPGATFKSLRFIDVEFSEPTIILFEREDFKGKKIELNAETVNLRSLGFNTQIRSVQVIGGIWVTYEYGSYRGRQFLLSPAEVPNWYEFSGCRQIGSLRPFVQKRIYFRLRNKATGLFMSTNGNLEDLKLLRIQVMEDVGADDQIWIYQEGCIKCRIAEDCCLTIVGSLVTSGSKLGLALDQNADSQFWSLKSDGRIYSKLKPNLVLDIKGGTQYDQNHIILNTVSKEKFTQVWEAMVLYT

SEQ ID NO: 35984 - protein, 167 aa, Homo sapiens
MVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTLQTQPLGTIVNGLFVVQKVTEKKKNILFDLSDNTGKMEVLGVRNEDTMKC

SEQ ID NO: 35985 - protein, 343 aa, Homo sapiens
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQKQMVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTLQTQPLGTIVNGLFVVQKVTEKKKNILFDLSDNTGKMEVLGVRNEDTMKCKEGDKVRLTFFTLSKNGEKLQLTSGVHSTIKVIKAKKKT

SEQ ID NO: 35986 - protein, 136 aa, Homo sapiens
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQK

SEQ ID NO: 35987 - protein, 599 aa, Homo sapiens
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVYAQRQESGSCRQTDHRWKSRGARRCFLEPRDPGSVPGHP

SEQ ID NO: 35988 - protein, 672 aa, Homo sapiens
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 35989 - protein, 253 aa, Homo sapiens
MRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGYLGSWRLLQNQPQDRGHRHAWPE

SEQ ID NO: 35990 - protein, 614 aa, Homo sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 35991 - protein, 617 aa, Homo sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATASEAPSTCPGFTHGEAAPRPGLPLPLLLLHQLLLLFLSHLRRL

SEQ ID NO: 35992 - protein, 617 aa, Homo sapiens; identical to SEQ ID NO: 35991

SEQ ID NO: 35993 - protein, 614 aa, Homo sapiens; identical to SEQ ID NO: 35990

SEQ ID NO: 35994 - protein, 526 aa, Homo sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 35995 - protein, 601 aa, Homo sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATGMQGPAGSGRRGVGARCNPSLLPLASE

SEQ ID NO: 35996 - protein, 614 aa, Homo sapiens; identical to SEQ ID NO: 35990

SEQ ID NO: 35997 - protein, 159 aa, Homo sapiens
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGAS

SEQ ID NO: 35998 - protein, 28 aa, Homo sapiens
MRPPQCLLHTPSLASPLLLLLLWLLGGG

SEQ ID NO: 35999 - protein, 93 aa, Homo sapiens
MLGLVMSCPDRTLVTKVRSHPSGNQHRPTRGGSRSFHCRRGVPRPAALRVLPRCPAFSDAACPAAMRPPQCLLHTPSLASPLLLLLLWLLGGG

SEQ ID NO: 36000 - protein, 427 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 36001 - protein, 397 aa, Homo sapiens
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 36002 - protein, 426 aa, Homo sapiens
MGSHPVLRIWGNRRATAASLGRSGGRLSSPRLLRVVAPTLTFAQTSRCSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRTGVKIGEMPLTDSILCDGLTDAFHNCHMGITAENVAKKWQVSREDQDKVAVLSQNRTENAQKAGHFDKEIVPVLVSTRKGLIEVKTDEFPRHGSNIEAMSKLKPYFLTDGTGTVTPANASGINDGAAAVVLMKKSEADKRGLTPLARIVSWSQVGVEPSIMGIGPIPAIKQAVTKAGWSLEDVDIFEINEAFAAVSAAIVKELGLNPEKVNIEGGAIALGHPLGASGCRILVTLLHTLERMGRSRGVAALCIGGGMGIAMCVQRE

SEQ ID NO: 36003 - protein, 424 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 36004 - protein, 356 aa, Homo sapiens [sequence omitted]

SEQ ID NO: 36005 - protein, 153 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGWSPCPWLTEGTLEILLRA

SEQ ID NO: 36006 - protein, 126 aa, Homo sapiens
MSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGETGPG

SEQ ID NO: 36007 - protein, 331 aa, Homo sapiens
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGITSENVAERFGISREKQDTFALASQQKAARAQSKGCFQAEIVPVTTTVHDDKGTKRSITVTQDEGIRPSTTMEGLAKLKPAFKKDGSTTAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 36008 - protein, 2458 aa, Homo sapiens
MVLLLCLSCLIFSCLTFSWLKIWGKMTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASENPKLPELLCKNGVAFLGPPSEAMWALGDKIASTVVAQTLQVPTLPWSGSGLTVEWTEDDLQQGKRISVPEDVYDKGCVKDVDEGLEAAERIGFPLMIKASEGGGGKGIRKAESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGVPLHRLKDIRLLYGESPWGVTPISFETPSNPPLARGHVIAARITSENPDEGFKPSSGTVQELNFRSSKNVWGYFSVAATGGLHEFADSQFGHCFSWGENREEAISNMVVALKELSIRGDFRTTVEYLINLLETESFQNNDIDTGWLDYLIAEKVQAEKPDIMLGVVCGALNVADAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQRYRSGIRGYMKTVVLDLLRRYLRVEHHFQQAHYDKCVINLREQFKPDMSQVLDCIFSHAQVAKKNQLVIMLIDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 36009 - protein, 2458 aa, Homo sapiens; identical to SEQ ID NO: 36008

SEQ ID NO: 36010 - protein, 2388 aa, Homo sapiens
MVLLLCLSCLIFSCLTFSWLKIWGKMTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASENPKLPELLCKNGVAFLGPPSEAMWALGDKIASTVVAQTLQVPTLPWSGSGLTVEWTEDDLQQGKRISVPEDVYDKGCVKDVDEGLEAAERIGFPLMIKASEGGGGKGIRKAESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGVPLHRLKDIRLLYGESPWGVTPISFETPSNPPLARGHVIAARITSENPDEGFKPSSGTVQELNFRSSKNVWGYFSVAATGGLHEFADSQFGHCFSWGENREEAISNMVVALKELSIRGDFRTTVEYLINLLETESFQNNDIDTGWLDYLIAEKVQAEKPDIMLGVVCGALNVADAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQSKDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 36011 - protein, 1689 aa, Homo sapiens
LPFLLKPPQTLPSPDAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQRYRSGIRGYMKTVVLDLLRRYLRVEHHFQQAHYDKCVINLREQFKPDMSQVLDCIFSHAQVAKKNQLVIMLIDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 36012 - protein, 143 aa, Homo sapiens
MTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILG

SEQ ID NO: 36013 - protein, 858 aa, Homo sapiens
MTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKGCLGTWRDVSWWKIRAMLPMHIGEGSV

SEQ ID NO: 36014 - protein, 345 aa, Homo sapiens
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGGAGALAKECMSLYPGCKITVFDIPEVVWTAKQHFSFQEEEQIDFQEGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 36015 - protein, 298 aa, Homo sapiens
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 36016 - protein, 373 aa, Homo sapiens
MGSSEDQAYRLLNDYANGFMVSQVLFAACELGVFDLLAEAPGPLDVAAVAAGVRASAHGTELLLDICVSLKLLKVETRGGKAFYRNTELSSDYLTTVSPTSQCSMLKYMGRTSYRCWGHLADAVREGRNQYLETFGVPAEELFTAIYRSEGERLQFMQALQEVWSVNGRSVLTAFDLSVFPLMCDLGGTWIKLETIILSKLSQGQKTKHRVFSLIGGAGALAKECMSLYPGCKITVFDIPEVVWTAKQHFSFQEEEQIDFQEGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 36017 - protein, 124 aa, Homo sapiens
DCRLTSVCLPCVPGDFFKDPLPEADLYILARVLHDWADGKCSHLLERIYHTCKPGGGILVIESLLDEDRRGPLLTQLYSLNMLVQTEGQERTPTHYHMLLSSAGFRDFQFKKTGAIYDAILARK

SEQ ID NO: 36018 - protein, 236 aa, Homo sapiens
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 36019 - protein, 193 aa, Homo sapiens
MDGGTLPRSAPPAPPVPVGCAARRRPASPELLRCSRRRRPATAETGGGAAAVARRNERERNRVKLVNLGFQALRQHVPHGGASKKLSKVETLRSAVEYIRALQRLLAEHDAVRNALAGGLRPQAVRPSAPRGPPGTTPVAASPSRASSSPGRGGSSEPGSPRSAYSSDDSGCEGALSPAERELLDFSSWLGGY

SEQ ID NO: 36020 - protein, 513 aa, Homo sapiens
MCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNCTIVPSLKHRLQRNVASLAWKPLSASVLAVACQSCILIWTLDPTSLSTRPSSGCAQVLSHPGHTPVTSLAWAPSGGRLLSASPVDAAIRVWDVSTETCVPLPWFRGGGVTNLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPCGIIQGEPGAQPQLITFHPSFNKGALLSVGWSTGRIAHIPLYFVNAQFPRFSPVLGRAQEPPAGGGGSIHDLPLFTETSPTSAPWDPLPGPPPVLPHSPHSHL

SEQ ID NO: 36021 - protein, 546 aa, Homo sapiens [sequence omitted]

SEQ ID NO: 36022 - protein, 112 aa, Homo sapiens
MAEQATKSVLFVCLGNICRSPIAEAVFRKLVTDQNISENWRVDSAATSGYEIGNPPDYRGQSCMKRHGIPMSHVARQVPSLDLKLCVLCFSGSLTAVLFLTGTWAGPQTQEL

SEQ ID NO: 36023 - protein, 158 aa, Homo sapiens
MAEQATKSVLFVCLGNICRSPIAEAVFRKLVTDQNISENWRVDSAATSGYEIGNPPDYRGQSCMKRHGIPMSHVARQITKEDFATFDYILCMDESNLRDLNRKSNQVKTCKAKIELLGSYDPQKQLIIEDPYYGNDSDFETVYQQCVRCCRAFLEKAH

SEQ ID NO: 36024 - protein, 158 aa, Homo sapiens
MAEQATKSVLFVCLGNICRSPIAEAVFRKLVTDQNISENWVIDSGAVSDWNVGRSPDPRAVSCLRNHGIHTAHKARQITKEDFATFDYILCMDESNLRDLNRKSNQVKTCKAKIELLGSYDPQKQLIIEDPYYGNDSDFETVYQQCVRCCRAFLEKAH

SEQ ID NO: 36025 - protein, 72 aa, Homo sapiens
MAEQATKSVLFVCLGNICRSPIAEAVFRKLVTDQNISENWRVDSAATSGGSLTAVLFLTGTWAGPQTKSCAA

SEQ ID NO: 36026 - protein, 160 aa, Homo sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRVRVASPSLGW

SEQ ID NO: 36027 - protein, 423 aa, Homo sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 36028 - protein, 391 aa, Homo sapiens
MAGKRSGWSRAALLQLLLGVNLVVMPPTRARSLRFVTLEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 36029 - protein, 236 aa, Homo sapiens
MVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 36030 - protein, 413 aa, Homo sapiens
MAGKRSGWSRAALLQLLLGVNLVVMPPTRARSLRFVTLLYRHGDRSPVKTYPKDPYQEEEWPQGFGQLTKEGMLQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 36031 - protein, 325 aa, Homo sapiens
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 36032 - protein, 325 aa, Homo sapiens; identical to SEQ ID NO: 36031

SEQ ID NO: 36033 - protein, 325 aa, Homo sapiens; identical to SEQ ID NO: 36031

SEQ ID NO: 36034 - protein, 325 aa, Homo sapiens; identical to SEQ ID NO: 36031

SEQ ID NO: 36035 - protein, 386 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 36036 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 36037 - protein, 426 aa, Homo sapiens
MAGLGFWGHPAGPLLLLLLLVLPPRALPEGPLVFVALVFRHGDRAPLASYPMDPHKEVASTLWPRGLGQLTTEGVRQQLELGRFLRSRYEAFLSPEYRREEVYIRSTDFDRTLESAQANLAGLFPEAAPGSPEARWRPIPVHTVPVAEDKLLRFPMRSCPRYHELLREATEAAEYQEALEGWTGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 36038 - protein, 333 aa, Homo sapiens
MAGLGFWGHPAGPLLLLLLLVLPPRALPEGPLVFVALVFRHGDRAPLASYPMDPHKEVASTLWPRGLGQLTTEGVRQQLELGRFLRSRYEGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 36039 - protein, 210 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDDEEGYNDGEVDDEEDKKKKKKKKKKKKKKK

SEQ ID NO: 36040 - protein, 249 aa, Homo sapiens
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 36041 - protein, 131 aa, Homo sapiens
MEMGKWIHLELRNRTPSDVKELFLDNSQSNEGKLEGLTDEFEELELLNTINIGLTSIANLPKLNKLKKLELSSNRASVGLEVLAEKCPNLIHLNLSGNKIKDLSTIEPLKKLENLESLDLFTCEVTNLNNY

SEQ ID NO: 36042 - protein, 268 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 36043 - protein, 136 aa, Homo sapiens
MEMKKKINLELRNRSPEEEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 36044 - protein, 220 aa, Homo sapiens
MANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 36045 - protein, 227 aa, Homo sapiens
MEMKKKINLELRNRSPEEVTELVLDNCLCVNGEIEGLNDTFKELEFLSMANVELSSLARLPSLNKLRKQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 36046 - protein, 691 aa, Homo sapiens
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAPDDSSDDSEAPDDSSDDSEAPDDSSDDSEASDDSSDDSEASDDSSDDSEAPDDKSDDSDVPEDKSDDSDVPDDNSDDLEVPVPAEDLCNEGQIASDEEELVEAAAAVSQHDSSDDAGEQDLGENLSKPPSDPEANPEVSERKLPTEEEPAPVVEQSGKRKSKTKTIVEPPRKRQTKTKNIVEPPRKRQTKTKNIVEPLRKRKAKTKNVSVTPGHKKRGPSKKKPGAAKVEKRKTRTPKCKVPGCFLQDLEKSKKYSGKNLKRNKDELVQRIYDLFNRSVCDKKLPEKLRIGWNNKMVKTAGLCSTGEMWYPKWRRFAKIQIGLKVCDSADRIRDTLIHEMCHAASWLIDGIHDSHGDAWKYYARKSNRIHPELPRVTRCHNYKINYKVHYECTGCKTRIGCYTKSLDTSRFICAKCKGSLVMVPLTQKDGTRIVPHV

SEQ ID NO: 36047 - protein, 691 aa, Homo sapiens; identical to SEQ ID NO: 36046

SEQ ID NO: 36048 - protein, 179 aa, Homo sapiens
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 36049 - protein, 889 aa, Homo sapiens
MSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGLTPREFNSYGSRRGNDAVMARGTFANIRLLNRFLNKQAPQTIHLPSGEILDVFDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 36050 - protein, 434 aa, Homo sapiens
MSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAL

SEQ ID NO: 36051 - protein, 889 aa, Homo sapiens; identical to SEQ ID NO: 36049

SEQ ID NO: 36052 - protein, 781 aa, Homo sapiens
QLEPRSARERVPLLGSGSPVAGAPPCSRRNTWPSVIMSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGFERQLTQENTDLCLSPPLLTSLSSPLKLWGQLFCHGEQCLGDLEK

SEQ ID NO: 36053 - protein, 790 aa, Homo sapiens
MRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGLTPREFNSYGSRRGNDAVMARGTFANIRLLNRFLNKQAPQTIHLPSGEILDVFDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 36054 - protein, 780 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 36055 - protein, 805 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGEEGGQATWPLPCAGPDGSPVGSRSGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 36056 - protein, 501 aa, Homo sapiens
MATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 36057 - protein, 761 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 36058 - protein, 421 aa, Homo sapiens
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 36059 - protein, 210 aa, Homo sapiens
MNRFLLLMSLYLLGSARGTSSQPNELSGSIDHQTSVQQLPGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 36060 - protein, 246 aa, Homo sapiens
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGTILNCYTCAYMNDQGKCLRGEGTCITQNSQQCMLKKIFEGGKLQFMVQGCENMCPSMNLFSHGTRMQIICCRNQSFCNKI

SEQ ID NO: 36061 - protein, 155 aa, Homo sapiens
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGEHASGEQASGAPISSTSTGGKLQFMVQGCENMCPSMNLFSHGTRMQIICCRNQSFCNKI

SEQ ID NO: 36062 - protein, 165 aa, Homo sapiens [sequence omitted]

SEQ ID NO: 36063 - protein, 81 aa, Homo sapiens
MNRFLLLMSLYLLGSARGTSSQPNELSGSIDHQTSVQQLPGGKLQFMVQGCENMCPSMNLFSHGTRMQIICCRNQSFCNKI

SEQ ID NO: 36064 - protein, 121 aa, Homo sapiens
MNRFLLLMSLYLLGSARGTSSQPNELSGSIDHQTSVQQLPGTILNCYTCAYMNDQGKCLRGEGTCITQNSQQCMLKKIFEGGKLQFMVQGCENMCPSMNLFSHGTRMQIICCRNQSFCNKI

SEQ ID NO: 36065 - protein, 195 aa, Homo sapiens
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 36066 - protein, 246 aa, Homo sapiens; identical to SEQ ID NO: 36060

SEQ ID NO: 36067 - protein, 170 aa, Homo sapiens
MNRFLLLMSLYLLGSARGTSSQPNELSGSIDHQTSVQQLPGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 36068 - protein, 176 aa, Homo sapiens
MNRFLLLMSLYLLGSARGTSSQPNELSGSIDHQTSVQQLPGEQPSGEQPSGEHLSGEQPLSELESGEQPSDEQPSGEHGSGEQPSGEQASGEQPSGTILNCYTCAYMNDQGKCLRGEGTCITQNSQQCMLKKIFEGGKLQFMVQGCENMCPSMNLFSHGTRMQIICCRNQSFCNKI

SEQ ID NO: 36069 - protein, 195 aa, Homo sapiens; identical to SEQ ID NO: 36065

SEQ ID NO: 36070 - protein, 210 aa, Homo sapiens; identical to SEQ ID NO: 36059

SEQ ID NO: 36071 - protein, 265 aa, Homo sapiens
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 36072 - protein, 573 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKQKSSWLMLKGDADTRTNSPDLDTQSLSHSSGTDRDPLQRMAGDSFHSREKIYPYDSLIVTNRIRVKLPKDVDRTRLERHLSPEEFQEVFGMSIEEFDRLALWKRNDLKKKALLF

SEQ ID NO: 36073 - protein, 346 aa, Homo sapiens
MFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 36074 - protein, 611 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 36075 - protein, 572 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 36076 - protein, 531 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 36077 - protein, 644 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPPPTSRHLATHVPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 36078 - protein, 521 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKQKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 36079 - protein, 470 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKQKSSWLMLKGDADTRTNSPDLDTQSLSHSSGTDRDPLQRMAGDSFHSREWFF

SEQ ID NO: 36080 - protein, 645 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 36081 - protein, 559 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 36082 - protein, 346 aa, Homo sapiens; identical to SEQ ID NO: 36073

SEQ ID NO: 36083 - protein, 571 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSQQIYPYDSLIVTNRIRVKLPKDVDRTRLERHLSPEEFQEVFGMSIEEFDRLALWKRNDLKKKALLF

SEQ ID NO: 36084 - protein, 531 aa, Homo sapiens
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSREQIYPYDSLIVTNRIRVKLPKDVDRTRLERHLSPEEFQEVFGMSIEEFDRLALWKRNDLKKKALLF

SEQ ID NO: 36085 - protein, 730 aa, Homo sapiens
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 36086 - protein, 730 aa, Homo sapiens; identical to SEQ ID NO: 36085

SEQ ID NO: 36087 - protein, 814 aa, Homo sapiens
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSWEPEDGFPASCSRGLGEEVLYDNAGLYDNLPPPHIFARYSPADRKASRLSADKLSSNHYKYPASAQSVTNTSSVGRASLGLNSQLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 36088 - protein, 768 aa, Homo sapiens
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGETANKPQNSVPEQPLPVNCVSELRKRSPSIVASNQGRVLQKAKEWEMKKT

SEQ ID NO: 36089 - protein, 725 aa, Homo sapiens
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGEWEMKKT

SEQ ID NO: 36090 - protein, 818 aa, Homo sapiens
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 36091 - protein, 814 aa, Homo sapiens
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENPKAVTPASAPDCTPVNSATTLKNRPLSVVVTGKGTVLQKAKEWEKKGAS

SEQ ID NO: 36092 - protein, 841 aa, Homo sapiens
QRVRALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNGHSGGFLPTGVPRWVQVPEGVIYATITLEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENPKAVTPASAPDCTPVNSATTLKNRPLSVVVTGKGTVLQKAKEWEKKGAS

SEQ ID NO: 36093 - protein, 312 aa, Homo sapiens
MERYKAQGCCCLVVQRRIRQVSASLEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQK

SEQ ID NO: 36094 - protein, 312 aa, Homo sapiens; identical to SEQ ID NO: 36093

SEQ ID NO: 36095 - protein, 871 aa, Homo sapiens
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMRILTLGQISGAQSFSPDGTHLTGTEFLGGWSWRPSQIRLMSPGTHWGDLTATEIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 36096 - protein, 333 aa, Homo sapiens
MCEEETTALVCDNGSGLCKAGFAGDDAPRAVFPSIVGRPRHQIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 36097 - protein, 370 aa, Homo sapiens
MSLHQFLLEPITCHAWNRDRTQIALSPNNHEVHIYKKNGSQWVKAHELKEHNGHITGIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKTLESSIQGLRIM

SEQ ID NO: 36098 - protein, 345 aa, Homo sapiens
MHERFIHCFCIDWAPKSDRIVTCGADRNAYVWSQKDGVWKPTLVILRINRAATFVKWSPLENKFAVGSGARLISVCYFESENDWWVSKHIKKPIRSTVLSLDWHPNNVLLAAGSCDFKCRVFSAYIKEVDEKPASTPWGSKMPFGQLMSEFGGSGTGGWVHGVSFSASGSRLAWVSHDSTVSVADASKSVQVSTLKTEFLPLLSVSFVSENSVVAAGHDCCPMLFNYDDRGCLTFVSKLDIPKQSIQRNMSAMERFRNMDKRATTEDRNTALETLHQNSITQVSIYEVDKQDCRKFCTTGIDGAMTIWDFKEPSRHGLPQLPGGAHQLPRLEQGPHPDCHLPQQP

SEQ ID NO: 36099 - protein, 372 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 36100 - protein, 102 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCV

SEQ ID NO: 36101 - protein, 130 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQEND

SEQ ID NO: 36102 - protein, 83 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKG

SEQ ID NO: 36103 - protein, 133 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWV

SEQ ID NO: 36104 - protein, 21 aa, Homo sapiens
MAYHSFLVEPISCHAWNKDRT

SEQ ID NO: 36105 - protein, 133 aa, Homo sapiens; identical to SEQ ID NO: 36103

SEQ ID NO: 36106 - protein, 108 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNE

SEQ ID NO: 36107 - protein, 372 aa, Homo sapiens; identical to SEQ ID NO: 36099

SEQ ID NO: 36108 - protein, 128 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQE

SEQ ID NO: 36109 - protein, 133 aa, Homo sapiens; identical to SEQ ID NO: 36103

SEQ ID NO: 36110 - protein, 300 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKKDRVTVVFSTVFKDDDDVVIGKVFMQEFKEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITGKTFSSR

SEQ ID NO: 36111 - protein, 300 aa, Homo sapiens; identical to SEQ ID NO: 36110

SEQ ID NO: 36112 - protein, 90 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESG

SEQ ID NO: 36113 - protein, 287 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 36114 - protein, 254 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 36115 - protein, 342 aa, Homo sapiens
MCDEDETTALVCDNGSGLVKAGFAGDDAPRAVFPSIVGRPRHQGVMVGMGQKDSYVGDEAQSKRGILTLKYPIEHGIITKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 36116 - protein, 289 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANPEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 36117 - protein, 377 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 36118 - protein, 381 aa, Homo sapiens
MAPGEKESGEGPAKSALRKIRTATLVISLARGWQQWANENSIRQAQEPTGWLPGGTQDSPQAPKPITPPTSHQKAQSAPKSPPRLPEGHGDGQSSEKAPEVSHIKKKEVSKTVVSKTYERGGDVSHLSHRYERDAGVLEPGQPENDIDRILHSHGSPTRRRKCANLVSELTKGWRVMEQEEPTWRSDSVDTEDSGYGGEAEERPEQDGVQVAVVRIKRPLPSQVNRFTEKLNCKAQQKYSPVGNLKGRWQQWADEHIQSQKLNPFSEEFDYELAMSTRLHKGDEGYGRPKEGTKTAERAKRAEEHIYREMMDMCFIICTMARHRRDGKIQVTFGDLFDRYVRISDKVVGILMRARKHGLVDFEGEMLWQGRDDHVVITLLK

SEQ ID NO: 36119 - protein, 894 aa, Homo sapiens
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 36120 - protein, 894 aa, Homo sapiens
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDLVYTARPDERAIMTYVSCYYHAFAGAQKAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 36121 - protein, 663 aa, Homo sapiens
STLSSVEGPPESSTCSYQEMRRSSVNSSAMAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 36122 - protein, 388 aa, Homo sapiens
MEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 36123 - protein, 376 aa, Homo sapiens
MFNPHALDVPAVIFDNGSGLCKAGLSGEIGPRHVISSVLGHCKFNVPLARLNQKYFVGQEALYKYEALHLHYPIERGLVTGWDDMEKLWKHLFERELGVKPSQQPVLMTEPSLNPREIREKLAEMMFETFSVPGFYLSNHAVAALYASACVTGLVVDSGDGVTCTVPIFEGYSLPHAVTKLCMAGRDITEHLTRLLFASGFNFPCILNKAVVNNIKEKLCYIALEPEKELRKSRGEVLGAYRLPDGHVIHFGDELYQVPEVLFAPDQLGIHSPGLSKMVSSSIMKCDTDIQNKLYADIVLSGGTTLLPGLEERLMKEVEQLASKGTPIKITASPDRCFSAWIGASIMTSMSSFKQMWVTSADFKEYGTSVVQRRCF

SEQ ID NO: 36124 - protein, 377 aa, Homo sapiens
MFNPHALDSPAVIFDNGSGFCKAGLSGEFGPRHMVSSIVGHLKFQAPSAEANQKKYFVGEEALYKQEALQLHSPFERGLITGWDDVERLWKHLFEWELGVKPSDQPLLATEPSLNPRENREKMAEVMFENFGVPAFYLSDQAVLALYASACVTGLVVDSGDAVTCTVPIFEGYSLPHAVTKLHVAGRDITELLMQLLLASGHTFPCQLDKGLVDDIKKKLCYVALEPEKELSRRPEEVLREYKLPDGNIISLGDPLHQAPEALFVPQQLGSQSPGLSNMVSSSITKCDTDIQKILFGEIVLSGGTTLFHGLDDRLLKELEQLASKDTPIKITAPPDRWFSTWIGASIVTSLSSFKQMWVTAADFKEFGTSVVQRRCF

SEQ ID NO: 36125 - protein, 328 aa, Homo sapiens
MFNPHALDSPAVIFDNGSGFCKAGLSGEFGPRHMVSSIVGHLKFQAPSAEANQKKYFVGEEALYKQEALQLHSPFERGLITGWDDVERLWKHLFEWELGVKPSDQPLLATEPSLNPRENREKMAEVMFENFGVPAFYLSDQAVLALYASACVTGLVVDSGDAVTCTVPIFEGYSLPHAVTKLHVAGRDITELLMQLLLASGHTFPCQLDKGLVDDIKKKLCYVALEPEKELSRRPEEVLREYKLPDGNIISLGDPLHQAPEALFVPQQLGSQSPGLSNMVSSSITKCDTDIQKILFGEIVLSGGTTLFHGLDDRLLHLDWSLHRHLSE

SEQ ID NO: 36126 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 36127 - protein, 305 aa, Homo sapiens
MDPVTQLYTMTSTLEYKTTKADIQMPFTCSVTYYGPSGQKTIHSEQAVFDIYYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 36128 - protein, 344 aa, Homo sapiens
  MOD_RES (1)..(1): Any amino acid
XLGDCISEDSYPDGNITWYRNGKVLHPLEGAVVIIFKKEMDPVTQLYTMTSTLEYKTTKADIQMPFTCSVTYYGPSGQKTIHSEQAVFDIYYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 36129 - protein, 570 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 36130 - protein, 357 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKLFENFYFGSLKLNSIHISQRFTVDSFGNYASCGQIDFS

SEQ ID NO: 36131 - protein, 357 aa, Homo sapiens; identical to SEQ ID NO: 36130

SEQ ID NO: 36132 - protein, 400 aa, Homo sapiens
MEVLRPQLIRIDGRNYRKNPVQEQTYQHEEDEEDFYQGSMECADEPCDAYEVEQTPQGFRSTLRAPSLLYNLIHLNTSNDCGFQKITLDCQNIYTWKSRHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKSFALLPRLEYNDAISAHCNLCLPGSSDSPASASQVAGITGVSDAYSQSLPGKS

SEQ ID NO: 36133 - protein, 357 aa, Homo sapiens; identical to SEQ ID NO: 36130

SEQ ID NO: 36134 - protein, 400 aa, Homo sapiens; identical to SEQ ID NO: 36132

SEQ ID NO: 36135 - protein, 357 aa, Homo sapiens; identical to SEQ ID NO: 36130

SEQ ID NO: 36136 - protein, 292 aa, Homo sapiens
  MOD_RES (1)..(1): Any amino acid
XYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKSFALLPRLEYNDAISAHCNLCLPGSSDSPASASQVAGITVV

SEQ ID NO: 36137 - protein, 275 aa, Homo sapiens
METKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKSFALLPRLEYNDAISAHCNLCLPGSSDSPASASQVAGITVV

SEQ ID NO: 36138 - protein, 123 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVL

SEQ ID NO: 36139 - protein, 103 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEI

SEQ ID NO: 36140 - protein, 152 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLR

SEQ ID NO: 36141 - protein, 56 aa, Homo sapiens
MEVLRPQLIRIDGRNYRKNPVQEQTYQHEEDEEDFYQGSMECADEPCDAYEVEQTP

SEQ ID NO: 36142 - protein, 379 aa, Homo sapiens
MMKYPGTWPCQGIIGISFGESVMEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKLFENFYFGSLKLNSIHISQRFTVDSFGNYASCGQIDFS

SEQ ID NO: 36143 - protein, 757 aa, Homo sapiens
MPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 36144 - protein, 757 aa, Homo sapiens; identical to SEQ ID NO: 36143

SEQ ID NO: 36145 - protein, 240 aa, Homo sapiens
MPALPLDQLQITHKDPKTGKLRTSPALHPEQKADRYFVLYKPPPKDNIPALVEEYLERATFVANDLDWLLALPHDKFWCQVIFDETLQKCLDSYLRYVPRKFDEGVASAPEVVDMQKRLHRSVFLTFLRMSTHKESKDHFISPSAFGEILYNNFLFDIPKILDLCVLFGKGNSPLLQKMIGNIFTQQPSYYSDLDETLPTILQVFSNILQHCGLQGDGANTTPQKLEERGRLTPSDMPLL

SEQ ID NO: 36146 - protein, 681 aa, Homo sapiens
MPALPLDQLQITHKDPKTGKLRTSPALVIFDETLQKCLDSYLRYVPRKFDEGVASAPEVVDMQKRLHRSVFLTFLRMSTHKESKILDLCVLFGKGNSPLLQKMIGNIFTQQPSYYSDLDETLPTILQVFSNILQHCGLQGDGANTTPQKLEERGRLTPSDMPLLELKDIVLYLCDTCTTLWAFLDIFPLACQTFQKHDFCYRLASFYEAAIPEMESAIKKRRLEDSKLLGDLWQRLSHSRKKLMEIFHIILNQICLLPILESSCDNIQGFIEEFLQIFSSLLQEKRFLRDYDALFPVAEDISLLQQASSVLDETRTAYILQAVESAWEGVDRRKATDAKDPSVIEEPNGEPNGVTVTAEAVSQASSHPENSEEEECMGAAAAVGPAMCGVELDSLISQVKDLLPDLGEGFILACLEYYHYDPEQVINNILEERLAPTLSQLDRNLDREMKPDPTPLLTSRHNVFQNDEFDVFSRDSVDLSRVHKGKSTRKEENTRSLLNDKRAVAAQRQRYEQYSVVVEEVPLQPGESLPYHSVYYEDEYDDTYDGNQVGANDADSDDELISRRPFTIPQVLRTKVPREGQEEDDDDEEDDADEEAPKPDHFVQDPAVLREKAEARRMAFLAKKGYRHDSSTAVAGSPRGHGQSRETTQERRKKEANKATRANHNRRTMADRKRSKGMIPS

SEQ ID NO: 36147 - protein, 176 aa, Homo sapiens
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDLTALVQMTEKEHGDRVFFGKNLAFSFDMHDL

SEQ ID NO: 36148 - protein, 111 aa, Homo sapiens
MALPRLTGALRSFSNVTKQDNYNEEVADLKIKRSKLHEQVLDLGLTWKKIIKFLNEKLEKSKMQSINEDLKDILHAAKQIEVNCPFQKRRLDGKEEDEKMSRASDRFRGLR

SEQ ID NO: 36149 - protein, 2202 aa, Homo sapiens
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDLTALVQMTEKEHGDRVFFGKNLAFSFDMHDLDHFDELPINGETQKTISLDYKKFLNEHLQEACTPELKPVEKTNGSFLWCEVEKYLNSTLKEMTEVPRVEDLCCTLYDMLASIKSGDELQDELFELLGPEGLELIEKLLQNRITIVDRFLNSSNDHRFQALQDNCKKILGENAKPNYGCQVTIQSEQEKQLMKQYRREEKRIARREKKAGEDLEVSEGLMCFDPKELRIQREQALLNARSVPILSRQRDADVEKIHYPHVYDSQAEAMKTSAFIAGAKMILPEGIQRENNKLYEEVRIPYSEPMPLSFEEKPVYIQDLDEIGQLAFKGMKRLNRIQSIVFETAYNTNENMLICAPTGAGKTNIAMLTVLHEIRQHFQQGVIKKNEFKIVYVAPMKALAAEMTDYFSRRLEPLGIIVKELTGDMQLSKSEILRTQMLVTTPEKWDVVTRKSVGDVALSQIVRLLILDEVHLLHEDRGPVLESIVARTLRQVESTQSMIRILGLSATLPNYLDVATFLHVNPYIGLFFFDGRFRPVPLGQTFLGIKCANKMQQLNNMDEVCYENVLKQVKAGHQVMVFVHARNATVRTAMSLIERAKNCGHIPFFFPTQGHDYVLAEKQVQRSRNKQVRELFPDGFSIHHAGMLRQDRNLVENLFSNGHIKVLVCTATLAWGVNLPAHAVIIKGTQIYAAKRGSFVDLGILDVMQIFGRAGRPQFDKFGEGIIITTHDKLSHYLTLLTQRNPIESQFLESLADNLNAEIALGTVTNVEEAVKWISYTYLYVRMRANPLAYGISHKAYQIDPTLRKHREQLVIEVGRKLDKAQMIRFEERTGYFSSTDLGRTASHYYIKYNTIETFNELFDAHKTEGDIFAIVSKAEEFDQIKVREEEIEELDTLLSNFCELSTPGGVENSYGKINILLQTYISRGEMDSFSLISDSAYVAQNAARIVRALFEIALRKRWPTMTYRLLNLSKVIDKRLWGWASPLRQFSILPPHILTRLEEKKLTVDKLKDMRKDEIGHILHHVNIGLKVKQCVHQIPSVMMEASIQPITRTVLRVTLSIYADFTWNDQVHGTVGEPWWIWVEDPTNDHIYHSEYFLALKKQVISKEAQLLVFTIPIFEPLPSQYYIRAVSDRWLGAEAVCIINFQHLILPERHPPHTELLDLQPLPITALGCKAYEALYNFSHFNPVQTQIFHTLYHTDCNVLLGAPTGSGKTVAAELAIFRVFNKYPTSKAVYIAPLKALVRERMDDWKVRIEEKLGKKVIELTGDVTPDMKSIAKADLIVTTPEKWDGVSRSWQNRNYVQQVTILIIDEIHLLGEERGPVLEVIVSRTNFISSHTEKPVRIVGLSTALANARDLADWLNIKQMGLFNFRPSVRPVPLEVHIQGFPGQHYCPRMASMNKPAFQAIRSHSPAKPVLIFVSSRRQTRLTALELIAFLATEEDPKQWLNMDEREMENIIATVRDSNLKLTLAFGIGMHHAGLHERDRKTVEELFVNCKVQVLIATSTLAWGVNFPAHLVIIKGTEYYDGKTRRYVDFPITDVLQMMGRAGRPQFDDQGKAVILVHDIKKDFYKKFLYEPFPVESSLLGVLSDHLNAEIAGGTITSKQDALDYITWTYFFRRLIMNPSYYNLGDVSHDSVNKFLSHLIEKSLIELELSYCIEIGEDNRSIEPLTYGRIASYYYLKHQTVKMFKDRLKPECSTEELLSILSDAEEYTDLPVRHNEDHMNSELAKCLPIESNPHSFDSPHTKAHLLLQAHLSRAMLPCPDYDTDTKTVLDQALRVCQAMLDVAANQGWLVTVLNITNLIQMVIQGRWLKDSSLLTLPNIENHHLHLFKKWKPIMKGPHARGRTSIESLPELIHACGGKDHVFSSMVESELHAAKTKQAWNFLSHLPVINVGISVKGSWDDLVEGHNELSVSTLTADKRDDNKWIKLHADQEYVLQVSLQRVHFGFHKGKPESCAVTPRFPKSKDEGWFLILGEVDKRELIALKRVGYIRNHHVASLSFYTPEIPGRYIYTLYFMSDCYLGLDQQYDIYLNVTQASLSAQVNTKVSDSLTDLALK

SEQ ID NO: 36150 - protein, 271 aa, Homo sapiens
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENRVAVLENQNKTLIEELKTLKDLYSNKSV

SEQ ID NO: 36151 - protein, 136 aa, Homo sapiens
MTNSGSTQQGTTILQYAQTSDGQQILVPSNQVVVQTASGDMQTYQIRTTPSATSLPQTVVMTSPVTLTSQTTKTDDPQLKREIRLMKNREAARECRRKKKEYVKCLENRVAVLENQNKTLIEELKTLKDLYSNKSV

SEQ ID NO: 36152 - protein, 200 aa, Homo sapiens
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQTASGDMQTYQIRTTPSATSLPQTVVMTSPV

SEQ ID NO: 36153 - protein, 170 aa, Homo sapiens
MEDSHKSTTSETAPQPGSAVQGAHISHIAQQVSSLSESEESQDSSDSIGSSQKAHGILARRPSYRKILKDLSSEDTRGRKGDGENSGVSAAVTSMSVPTPIYQTSSGQYIAIAPNGALQLASPGTDGVQGLQTLTMTNSGSTQQGTTILQYAQTSDGQQILVPSNQVVVQ

SEQ ID NO: 36154 - protein, 106 aa, Homo sapiens
MMLQHPGQVSASEEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 36155 - protein, 181 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 36156 - protein, 175 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIK

SEQ ID NO: 36157 - protein, 135 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 36158 - protein, 124 aa, Homo sapiens
MSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 36159 - protein, 181 aa, Homo sapiens; identical to SEQ ID NO: 36155

SEQ ID NO: 36160 - protein, 135 aa, Homo sapiens; identical to SEQ ID NO: 36157

SEQ ID NO: 36161 - protein, 351 aa, Homo sapiens
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 36162 - protein, 351 aa, Homo sapiens; identical to SEQ ID NO: 36161

SEQ ID NO: 36163 - protein, 351 aa, Homo sapiens; identical to SEQ ID NO: 36161

SEQ ID NO: 36164 - protein, 282 aa, Homo sapiens
MSLLATLGLELDRALLPASGLGWLVDYGKLPPAPAPLAPYEVLGGALEGGLPVGGEPLAGDGFSDWMTERVDFTALLPLEPPLPPGTLPQPSPTPPDLEAMASLLKKELEQMEDFFLDAPPLPPPSPPPLPPPPLPPAPSLPLSLPSFDLPQPPVLDTLDLLAIYCRNEAGQEEVGMPPLPPPQQPPPPSPPQPSRLAPYPHPATTRGDRKQKKRDQNKSAALRYRQRKRAEGEALEGECQGLEARNRELKERAESVEREIQYVKDLLIEVYKARSQRTRSC

SEQ ID NO: 36165 - protein, 670 aa, Homo sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 36166 - protein, 703 aa, Homo sapiens
MAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 36167 - protein, 222 aa, Homo sapiens
MAELMLLSEIADPTRFFTDNLLSPEDWGLQNSTLYSGLDEVAEEQTQLFRCPEQDVPFDGSSLDVGMDVSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRTTCCSQPSATTRPPGPRCPW

SEQ ID NO: 36168 - protein, 700 aa, Homo sapiens
MAELMLLSEIADPTRFFTDNLLSPEDWDSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 36169 - protein, 703 aa, Homo sapiens; identical to SEQ ID NO: 36166

SEQ ID NO: 36170 - protein, 700 aa, Homo sapiens; identical to SEQ ID NO: 36168

SEQ ID NO: 36171 - protein, 142 aa, Homo sapiens
  MOD_RES (1)..(1): Any amino acid
XQPSPTDQPSFSNLTAFPGGAKELLLRDLDQLFLSSDCRHFNRTESLRLADELSGWVQRHQRGRRKIPQRAQERQSLDTSPSRSLSHGRSHLQLRQSPSNPLDPQKGILWASCNYIATQTVRSQHSWMQLTDGKTHFMLSLS

SEQ ID NO: 36172 - protein, 142 aa, Homo sapiens; identical to SEQ ID NO: 36171
  MOD_RES (1)..(1): Any amino acid

SEQ ID NO: 36173 - protein, 703 aa, Homo sapiens; identical to SEQ ID NO: 36166

SEQ ID NO: 36174 - protein, 703 aa, Homo sapiens; identical to SEQ ID NO: 36166

SEQ ID NO: 36175 - protein, 700 aa, Homo sapiens; identical to SEQ ID NO: 36168

SEQ ID NO: 36176 - protein, 142 aa, Homo sapiens; identical to SEQ ID NO: 36171
  MOD_RES (1)..(1): Any amino acid

SEQ ID NO: 36177 - protein, 700 aa, Homo sapiens; identical to SEQ ID NO: 36168

SEQ ID NO: 36178 - protein, 142 aa, Homo sapiens; identical to SEQ ID NO: 36171
  MOD_RES (1)..(1): Any amino acid

SEQ ID NO: 36179 - protein, 222 aa, Homo sapiens; identical to SEQ ID NO: 36167

SEQ ID NO: 36180 - protein, 222 aa, Homo sapiens; identical to SEQ ID NO: 36167

SEQ ID NO: 36181 - protein, 222 aa, Homo sapiens; identical to SEQ ID NO: 36167

SEQ ID NO: 36182 - protein, 307 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEVDSSPPDSPASSPCSPPLKEKSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 36183 - protein, 494 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 36184 - protein, 462 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 36185 - protein, 483 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 36186 - protein, 483 aa, Homo sapiens; identical to SEQ ID NO: 36185

SEQ ID NO: 36187 - protein, 494 aa, Homo sapiens; identical to SEQ ID NO: 36183

SEQ ID NO: 36188 - protein, 117 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVVFRPRLFLLCFGIIFLIG

SEQ ID NO: 36189 - protein, 117 aa, Homo sapiens; identical to SEQ ID NO: 36188

SEQ ID NO: 36190 - protein, 1270 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 36191 - protein, 515 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNE

SEQ ID NO: 36192 - protein, 125 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKL

SEQ ID NO: 36193 - protein, 152 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASG

SEQ ID NO: 36194 - protein, 103 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQ

SEQ ID NO: 36195 - protein, 89 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWK

SEQ ID NO: 36196 - protein, 177 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSG

SEQ ID NO: 36197 - protein, 1270 aa, Homo sapiens; identical to SEQ ID NO: 36190

SEQ ID NO: 36198 - protein, 169 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDA

SEQ ID NO: 36199 - protein, 32 aa, Homo sapiens
MDSLEEPQKKVFKARKTMRVSDRQQLEAVYKV

SEQ ID NO: 36200 - protein, 132 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSG

SEQ ID NO: 36201 - protein, 176 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATS

SEQ ID NO: 36202 - protein, 59 aa, Homo sapiens
MDSLEEPQKKVFKARKTMRVSDRQQLEAVYKVKEELLKTDVKLLNGNHENGDLDPTSPL

SEQ ID NO: 36203 - protein, 1105 aa, Homo sapiens
MDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSKRFFLYMAPRYM

SEQ ID NO: 36204 - protein, 1278 aa, Homo sapiens
MHQDQRFRMDSLEEPQKKVFKARKTMRVSDRQQLEAVYKVKEELLKTDVKLLNGNHENGDLDPTSPLENMDYIKDKEEVNGIEEICFDPEGSKAEWKETPCILSVNVKNKQDDDLNCEPLSPHNITPEPVSKLPAEPVSGDPAPGDLDAGDPASGVLASGDSTSGDPTSSEPSSSDAASGDATSGDAPSGDVSPGDATSGDATADDLSSGDPTSSDPIPGEPVPVEPISGDCAADDIASSEITSVDLASGAPASTDPASDDLASGDLSSSELASDDLATGELASDELTSESTFDRTFEPKSVPVCEPVPEIDNIEPSSNKDDDFLEKNGADEKLEQIQSKDSLDEKNKADNNIDANEETLETDDTTICSDRPPENEKKVEEDIITELALGEDAISSSMEIDQGEKNEDETSADLVETINENVIEDNKSENILENTDSMETDEIIPILEKLAPSEDELTCFSKTSLLPIDETNPDLEEKMESSFGSPSKQESSESLPKEAFLVLSDEEDISGEKDESEVISQNETCSPAEVESNEKDNKPEEEEQVIHEDDERPSEKNEFSRRKRSKSEDMDNVQSKRRRYMEEEYEAEFQVKITAKGDINQKLQKVIQWLLEEKLCALQCAVFDKTLAELKTRVEKIECNKRHKTVLTELQAKIARLTKRFEAAKEDLKKRHEHPPNPPVSPGKTVNDVNSNNNMSYRNAGTVRQMLESKRNVSESAPPSFQTPVNTVSSTNLVTPPAVVSSQPKLQTPVTSGSLTATSVLPAPNTATVVATTQVPSGNPQPTISLQPLPVILHVPVAVSSQPQLLQSHPGTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRPLQPIQPAPPLQPSGVPTSGPSQTTIHLLPTAPTTVNVTHRPVTQVTTRLPVPRAPANHQVVYTTLPAPPAQAPLRGTVMQAPAVRQVNPQNSVTVRVPQTTTYVVNNGLTLGSTGPQLTVHHRPPQVHTEPPRPVHPAPLPEAPQPQRLPPEAASTSLPQKPHLKLARVQSQNGIVLSWSVLEVDRSCATVDSYHLYAYHEEPSATVPSQWKKIGEVKALPLPMACTLTQFVSGSKYYFAVRAKDIYGRFGPFCDPQSTDVISSTQSS

SEQ ID NO: 36205 - protein, 169 aa, Homo sapiens; identical to SEQ ID NO: 36198

SEQ ID NO: 36206 - protein, 543 aa, Homo sapiens
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKVANSEAMILDKNLESVNSPIEKSSVNYEPSNPSEKGSKKINLSSDQNKSVSESNNDDVMLISVESPNLTTPITSNPTDTRKITSGNSSNSPNAEVMKVQYPPWSHIRKLLQTQRKQPHWHKMQSRFLSPLSTCHLSQNHQHHYLN

SEQ ID NO: 36207 - protein, 682 aa, Homo sapiens
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKVANSEAMILDKNLESVNSPIEKSSVNYEPSNPSEKGSKKINLSSDQNKSVSESNNDDVMLISVESPNLTTPITSNPTDTRKITSGNSSNSPNAEVMAVQKKLDSIIDLTKEGLSNCNTESPVSPLESHSKAASNSKETTPLAQNAVQVPESFEHLPPLPEPPAPLPELVDKTRDTLPPQKPELKVKRVFRPNGIALTWNITKINPKCAPVESYHLFLCHENSNNKLIWKKIGEIKALPLPMACTLSQFLASNRYYFTVQSKDIFGRYGPFCDIKSIPGFSENLT

SEQ ID NO: 36208 - protein, 543 aa, Homo sapiens; identical to SEQ ID NO: 36206

SEQ ID NO: 36209 - protein, 682 aa, Homo sapiens; identical to SEQ ID NO: 36207

SEQ ID NO: 36210 - protein, 425 aa, Homo sapiens
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKIPEKLHQEILAILPMLKLWLYRRNLIL

SEQ ID NO: 36211 - protein, 226 aa, Homo sapiens
MLISVESPNLTTPITSNPTDTRKITSGNSSNSPNAEVMAVQKKLDSIIDLTKEGLSNCNTESPVSPLESHSKAASNSKETTPLAQNAVQVPESFEHLPPLPEPPAPLPELVDKTRDTLPPQKPELKVKRVFRPNGIALTWNITKINPKCAPVESYHLFLCHENSNNKLIWKKIGEIKALPLPMACTLSQFLASNRYYFTVQSKDIFGRYGPFCDIKSIPGFSENLT

SEQ ID NO: 36212 - protein, 198 aa, Homo sapiens [sequence omitted]

SEQ ID NO: 36213 - protein, 822 aa, Homo sapiens
MEEEEEAIGLLDKVLEDEDVFLLEECELGTPTSPGSGSPFLVAVKVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 36214 - protein, 859 aa, Homo sapiens
MEPLSHRGLPRLSWIDTLYSNFSYGTDEYDGEGNEEQKGPPEGSETMPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 36215 - protein, 363 aa, Homo sapiens
MKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEEVEKRGIEEVGIYRISGVATDIQALKAVFDANNKDILLMLSDMDINAIAGTLKLYFRELPEPLLTDRLSPCPTPTSSPSSSCWNT

SEQ ID NO: 36216 - protein, 641 aa, Homo sapiens
MEILLIIRFCCNCTYALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 36217 - protein, 310 aa, Homo sapiens
MTDVLPQPDCSPKAGREPLALEESGSKRPPNTGARLWGRVRNKLLRNKLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 36218 - protein, 813 aa, Homo sapiens
MPYIDESPTMSPQLSARSQGGGDGVSPTPPEGLAPGVEAGKGLEMRKLVLSGFLASEEIYINQLEALLLPMKPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSHTSVTMEALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCTLEVDSFGYFVSKAKTRVFRDTAEPKWDEEFEIELEGSQSLRILCYEKCYDKTKVNKDNNEIVDKIMGKGQIQLDPQTVETKNWHTDVIEMNGIKVEFSMKFTSRDMSLKRTPSKKQTGVFGVKISVVTKRERSKVPYIVRQCVEEVEKRGIEEVGIYRISGVATDIQALKAVFDANNKDILLMLSDMDINAIAGTLKLYFRELPEPLLTDRLYPAFMEGIALSDPAAKENCMMHLLRSLPDPNLITFLFLLEHLKRVAEKEPINKMSLHNLATVFGPTLLRPSEVESKAHLTSAADIWSHDVMAQVQVLLYYLQHPPISFAELKRNTLYFSTDV

SEQ ID NO: 36219 - protein, 443 aa, Homo sapiens
MLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 36220 - protein, 503 aa, Homo sapiens
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 36221 - protein, 503 aa, Homo sapiens; identical to SEQ ID NO: 36220

SEQ ID NO: 36222 - protein, 329 aa, Homo sapiens
MALTPPLLLLSAGTMTLGSPRKGLLMLLMALVTQGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 36223 - protein, 159 aa, Homo sapiens
MALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEGKGRYGEVWRGLWHGESVAVKIFSSRDEQSWFRETEIYNTV

SEQ ID NO: 36224 - protein, 517 aa, Homo sapiens
MALTPPLLLLSAGTMTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 36225 - protein, 509 aa, Homo sapiens
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 36226 - protein, 509 aa, Homo sapiens; identical to SEQ ID NO: 36225

SEQ ID NO: 36227 - protein, 509 aa, Homo sapiens; identical to SEQ ID NO: 36225

SEQ ID NO: 36228 - protein, 87 aa, Homo sapiens
MVDGVMILPVLIMIALPSPSMEDEKPKVNPKLYMCVCEGLSCGNEDHCEGQQCFSSLSINDGFHVYQKGCFQVYEQGKMTCKTPPSP

SEQ ID NO: 36229 - protein, 21 aa, Homo sapiens
MVDGVMILPVLIMIALPSPSM

SEQ ID NO: 36230 - protein, 71 aa, Homo sapiens
MVDGVMILPVLIMIALPSPSMEDEKPKVNPKLYMCVCEGLSCGNEDHCEGQQCFSSLSINDGFHVYQKGCF

SEQ ID NO: 36231 - protein, 509 aa, Homo sapiens; identical to SEQ ID NO: 36225

SEQ ID NO: 36232 - protein, 87 aa, Homo sapiens; identical to SEQ ID NO: 36228

SEQ ID NO: 36233 - protein, 73 aa, Homo sapiens
MVDGVMILPVLIMIALPSPSMEDEKPKVNPKLYMCVCEGLSCGNEDHCEGQQCFSSLSINDGFHVYQKGCFQV

SEQ ID NO: 36234 - protein, 505 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 36235 - protein, 487 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGTFLFCLCSYLPFQDAGSPKAVLLPPFFLQPVGCLLPEPESSFKVAIKGVEVAVLRVRLFFRDQFVE

SEQ ID NO: 36236 - protein, 476 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEVRSWPPAAFPSA

SEQ ID NO: 36237 - protein, 546 aa, Homo sapiens
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKADCSFLTLPWEVVMVSAAPKLRSLRLQYKGGRGRARFLFPLNNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 36238 - protein, 453 aa, Homo sapiens
MVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 36239 - protein, 493 aa, Homo sapiens
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 36240 - protein, 413 aa, Homo sapiens
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 36241 - protein, 336 aa, Homo sapiens
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 36242 - protein, 513 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 36243 - protein, 513 aa, Homo sapiens; identical to SEQ ID NO: 36242

SEQ ID NO: 36244 - protein, 405 aa, Homo sapiens
MCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 36245 - protein, 512 aa, Homo sapiens
MTAPWVALALLWGSLCAGSGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 36246 - protein, 396 aa, Homo sapiens
MELDHRTSGGLHAYPGPRGGQVAKPNVILQIGKCRAEMLEHVRRTHRHLLAEVSKQVERELKGLHRSVGKLESNLDGYVPTSDSQRWKKSIKACLCRCQETIANLERWVKREMHVWREVFYRLERWADRLESTGGKYPVGSESARHTVSVGVGGPESYCHEADGYDYTVSPYAITPPPAAGELPGQEPAEAQQYQPWVPGEDGQPSPGVDTQIFEDPREFLSHLEEYLRQVGGSEEYWLSQIQNHMNGPAKKWWEFKQGSVKNWVEFKKEFLQYSEGTLSREAIQRELDLPQKQGEPLDQFLWRKRDLYQTLYVDADEEEIIQYVVGTLQPKLKRFLRHPLPKTLEQLIQRGMEVQDDLEQAAEPAGPHLPVEDEAETLTPAPNSESVASDRTQPE

SEQ ID NO: 36247 - protein, 528 aa, Homo sapiens
MAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQEKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFWEFATDNYDIGFGVYFEWTDSPNTAVSVHVSESSDDDEEEEENIGCEEKAKKNANKPLLDEIVPVYRRDCHEEVYAGSHQYPGRGVYLLKFDNSYSLWRSKSVYYRVYYTR

SEQ ID NO: 36248 - protein, 780 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLRSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 36249 - protein, 676 aa, Homo sapiens
MKPGATGESDLAEVLPQHKFDSKSLEAYLNQHLSGFGAEREATLTIAQYRAGKSNPTFYLQKGFQTYVLRKKPPGSLLPKAHQIDREFKVQKALFSIGFPVPKPILYCSDTSVIGTEFYVMEHVQGRIFRDLTIPGLSPAERSAIYVATVETLAQLRSLNIQSLQLEGYGIGAGYCKRQVSTWTKQYQAAAHQDIPAMQQLSEWLMKNLPDNDNEENLIHGDFRLDNIVFHPKECRVIAVLDWELSTIGHPLSDLAHFSLFYFWPRTVPMINQGSYSENSGIPSMEELISIYCRCRGINSILPNWNFFLALSYFKMAGIAQGVYSRYLLGNNSSEDSFLFANIVQPLAETGLQLSKRTFSTVLPQIDTTGQLFVQTRKGQEVLIKVKHFMKQHILPAEKEVTEFYVQNENSVDKWGKPLVIDKLKEMAKVEGLWNLFLPAVSGLSHVDYALIAEETGKCFFAPDVFNCQAPDTGNMEVLHLYGSEEQKKQWLEPLLQGNITSCFCMTEPDVASSDATNIECSIQRDEDSYVINGKKWWSSGAGNPKCKIAIVLGRTQNTSLSREVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 36250 - protein, 305 aa, Homo sapiens
MEVLHLYGSEEQKKQWLEPLLQGNITSCFCMTEPDVASSDATNIECSIQRDEDSYVINGKKWWSSGAGNPKCKIAIVLGRTQNTSLSRHKQHSMILVPMNTPGVKIIRPLSVFGYTDNFHGGHFEIHFNQVRVPATNLILGEGRGFEISQGRLGPGRIHHCMRTVGLAERALQIMCERATQRIAFKKKLYAHEVVAHWIAESRIAIEKIRLLTLKAAHSMDTLGSAGAKKEIAMIKVAAPRAVSKIVDWAIQVCGGAGVSQDYPLANMYAITRVLRLADGPDEVHLSAIATMELRDQAKRLTAKI

SEQ ID NO: 36251 - protein, 415 aa, Homo sapiens
MLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 36252 - protein, 357 aa, Homo sapiens
MRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEELFWQGPGVQSRSFVPFGGPQIALLLPFSSGDLREG

SEQ ID NO: 36253 - protein, 272 aa, Homo sapiens
MGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGCPRLCHPHPRPPQCPEAVWRASGQ

SEQ ID NO: 36254 - protein, 226 aa, Homo sapiens
MKSRKNFKKWPLTLLPERWLQIWQSGTRSMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQKKQETLKLWIT

SEQ ID NO: 36255 - protein, 621 aa, Homo sapiens
MSGCGLFLRTTAAARACRGLVVSTANRRLLRTSPPVRAFAKELFLGKIKKKEVFPFPEVSQDELNEINQFLGPVEKFFTEEVDSRKIDQEGKIPDETLEKLKSLGLFGLQVPEEYGGLGFSNTMYSRLGEIISMDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 36256 - protein, 488 aa, Homo sapiens
MDGSITVTLAAHQAIGLKGIILAGTEEQKAKYLPKLASGEHIAAFCLTEPASGSDAASIRSRATLSEDKKHYILNGSKVWITNGGLANIFTVFAKTEVVDSDGSVKDKITAFIVERDFGGVTNGKPEDKLGIRGSNTCEVHFENTKIPVENILGEVGDGFKVAMNILNSGRFSMGSVVAGLLKRLIEMTAEYACTRKQFNKRLSEFGLIQEKFALMAQKAYVMESMTYLTAGMLDQPGFPDCSIEAAMVKVFSSEAAWQCVSEALQILGGLGYTRDYPYERILRDTRILLIFEGTNEILRMYIALTGLQHAGRILTTRIHELKQAKVSTVMDTVGRRLRDSLGRTVDLGLTGNHGVVHPSLADSANKFEENTYCFGRTVETLLLRFGKTIMEEQLVLKRVANILINLYGMTAVLSRASRSIRIGLRNHDHEVLLANTFCVEAYLQNLFSLSQLDKYAPENLDEQIKKVSQQILEKRAYICAHPLDRTC

SEQ ID NO: 36257 - protein, 168 aa, Homo sapiens
MEEQLVLKGGQHPHQPVWHDGRAVAGQPLHPHWAPQPRPRGSLGQHLLRGSLLAESLQPLSAGQVCSRKPRSRLRKCPSRSLRSEPISVPTLWTGHAERGQCPLLPPAPTHGPLLDDCYSFFRRLGLSQVKPFVPRLHLKGCRLAWESLFQVLTCRQCSLTGPSQLLN

SEQ ID NO: 36258 - protein, 412 aa, Homo sapiens
MAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 36259 - protein, 454 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCDYSVCPLLEACTLYLDAFFLLLTGSNLNLHLNLGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 36260 - protein, 421 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 36261 - protein, 425 aa, Homo sapiens
MAAGFGRCCRCSLQVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 36262 - protein, 385 aa, Homo sapiens
MLQEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 36263 - protein, 232 aa, Homo sapiens
MWITNGGKANWYFLLARSDPDPKAPANKAFTGFIVEADTPGIQIGRKELNMGQRCSDTRGIVFEDVKVPKENVLIGDGAGFKVAMGAFDKTRPVVAAGAVGLAQRALDEATKYALERKTFGKLLVEHQAISFMLAEMAMKVELARMSYQRAAWEVDSGRRNTYYASIAKAFAGDIANQLATDAVQILGGNGFNTEYPVEKLMRDAKIYQIYEGTSQIQRLIVAREHIDKYKN

SEQ ID NO: 36264 - protein, 430 aa, Homo sapiens [sequence omitted]

SEQ ID NO: 36265 - protein, 432 aa, Homo sapiens
MEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 36266 - protein, 330 aa, Homo sapiens
MGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 36267 - protein, 655 aa, Homo sapiens
MQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 36268 - protein, 633 aa, Homo sapiens
MQAARMAASLGRQLLRLGGGSSRLTALLGQPRPGPARRPYAGGAAQESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 36269 - protein, 701 aa, Homo sapiens
MPRGPQPSAARCTVDDESGLGAPGRGRAGRQSWVRARASGARRDSEMQAARMAASLGRQLLRLGGGSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 36270 - protein, 701 aa, Homo sapiens; identical to SEQ ID NO: 36269

SEQ ID NO: 36271 - protein, 678 aa, Homo sapiens
MLGGLAAAAGTRIMGKEIEAEAQRPLRQTWRPGQPPAMTAKTMSSRLTALLGQPRPGPARRPYAGGAAQLALDKSDSHPSDALTRKKPAKAESKSFAVGMFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 36272 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 36273 - protein, 660 aa, Homo sapiens
MNPDLRRERDSASFNPELLTHILDGSPEKTRRRREIENMILNDPDFQHEDLNFLTRSQRYEVAVRKSAIMVKKMREFGIADPDEIMWFKKLHLVNFVEPVGLNYSMFIPTLLNQGTTAQKEKWLLSSKGLQIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 36274 - protein, 622 aa, Homo sapiens
MILNDPDFQHEDLNFLTRSQRYEVAVRKSAIMVKKMREFGIADPDEIMWFKNFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 36275 - protein, 592 aa, Homo sapiens
MAAFIQRTPDNWHLRPDGNGPRFVHRGRPEPLDLHLGMFLPTLLHQATAEQQERFFMPAWNLEIIGTYAQTEMGHGTHLRGLETTATYDPETQEFILNSPTVTSIKWWPGGLGKTSNHAIVLAQLITKGKCYGLHAFIVPIREIGTHKPLPGITVGDIGPKFGYDEIDNGYLKMDNHRIPRENMLMKYAQVKPDGTYVKPLSNKLTYGTMVFVRSFLVGEAARALSKACTIAIRYSAVRHQSEIKPGEPEPQILDFQTQQYKLFPLLATAYAFQFVGAYMKETYHRINEGIGQGDLSELPELHALTAGLKAFTSWTANTGIEACRMACGGHGYSHCSGLPNIYVNFTPSCTFEGENTVMMLQTARFLMKSYDQVHSGKLVCGMVSYLNDLPSQRIQPQQVAVWPTMVDINSPESLTEAYKLRAARLVEIAAKNLQKEVIHRKSKEVAWNLTSVDLVRASEAHCHYVVVKLFSEKLLKIQDKAIQAVLRSLCLLYSLYGISQNAGDFLQGSIMTEPQITQVNQRVKELLTLIRSDAVALVDAFDFQDVTLGSVLGRYDGNVYENLFEWAKNSPLNKAEVHESYKHLKSLQSKL

SEQ ID NO: 36276 - protein, 660 aa, Homo sapiens; identical to SEQ ID NO: 36272

SEQ ID NO: 36277 - protein, 681 aa, Homo sapiens
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATYDAATQEFVIHSPTLTATKWWPGDLGRSATHALVQAQLICSGARRGMHAFIVPIRSLQDHTPLPGIIIGDIGPKMDFDQTDNGFLQLNHVRVPRENMLSRFAQVLPDGTYVKLGTAQSNYLPMVVVRVELLSGEILPILQKACVIAMRYSVIRRQSRLRPSDPEAKVLDYQTQQQKLFPQLAISYAFHFLAVSLLEFFQHSYTAILNQDFSFLPELHALSTGMKAMMSEFCTQGAEMCRRACGGHGYSKLSGLPSLVTKLSASCTYEGENTVLYLQVARFLVKSYLQTQMSPGSTPQRSLSPSVAYLTAPDLARCPAQRAADFLCPELYTTAWAHVAVRLIKDSVQHLQTLTQSGADQHEAWNQTTVIHLQAAKVHCYYVTVKGFTEALEKLENEPAIQQVLKRLCDLHAIHGILTNSGDFLHDAFLSGAQVDMARTAYLDLLRLIRKDAILLTDAFDFTDQCLNSALGCYDGNVYERLFQWAQKSPTNTQENPAYEEYIRPLLQSWRSKL

SEQ ID NO: 36278 - protein, 171 aa, Homo sapiens
MGSPVHRVSLGDTWSRQMHPDIESERYMQSFDVERLTNILDGGAQNTALRRKVESIIHSYPEFSCKDNYFMTQNERYKAAMRRAFHIRLIARRLGWLEDGRELGYAYRALSGDVALNIHRVFVRALRSLGSEEQIAKWDPLCKNIQIIATYAQTELGHGTYLQGLETEATY

SEQ ID NO: 36279 - protein, 700 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRGGYFSGEQAGEVLESAVLALCSQLKDDAVALVDVIAPPDFVLDSPIGRADGELYKNLWGAVLQESKVLERASWWPEFSVNKPVIGSLKSKL

SEQ ID NO: 36280 - protein, 624 aa, Homo sapiens
MASTVEGGDTALLPEFPRGPLDAYRARASFSWKELALFTEGEGMLRFKKTIFSALENDPLFARSPGADLSLEKYRELNFLRCKRIFEYDFLSVEDMFKSPLKVPALIQCLGMYDSSLAAKYLLHSLVFGSAVYSSGSERHLTYIQKIFRMEIFGCFALTELSHGSNTKAIRTTAHYDPATEEFIIHSPDFEAAKFWVGNMGKTATHAVVFAKLCVPGDQCHGLHPFIVQIRDPKTLLPMPGVMVGDIGKKLGQNGLDNGFAMFHKVRVPRQSLLNRMGDVTPEGTYVSPFKDVRQRFGASLGSLSSGRVSIVSLAILNLKLAVAIALRFSATRRQFGPTEEEEIPVLEYPMQQWRLLPYLAAVYALDHFSKSLFLDLVELQRGLASGDRSARQAELGREIHALASASKPLASWTTQQGIQECREACGGHGYLAMNRLGVLRDDNDPNCTYEGDNNILLQQTSNYLLGLLAHQVHDGACFRSPLKSVDFLDAYPGILDQKFEVSSVADCLDSAVALAAYKWLVCYLLRETYQKLNQEKRSGSSDFEARNKCQVSHGRPLALAFVELTVVQRFHEHVHQPSVPPSLRAVLGRLSALYALWSLSRHAALLYRAERRCSCPGRRDRSS

SEQ ID NO: 36281 - protein, 700 aa, Homo sapiens; identical to SEQ ID NO: 36279

SEQ ID NO: 36282 - protein, 724 aa, Homo sapiens
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 36283 - protein, 482 aa, Homo sapiens
MANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 36284 - protein, 666 aa, Homo sapiens
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 36285 - protein, 615 aa, Homo sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 36286 - protein, 640 aa, Homo sapiens
MAVYVGMLRLGRLCAGSSGVLGARAALSRSWQEARLQGVRFLSARGGMEAGRQRISVPSSFTASAAAHSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 36287 - protein, 602 aa, Homo sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 36288 - protein, 572 aa, Homo sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 36289 - protein, 455 aa, Homo sapiens
MELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 36290 - protein, 576 aa, Homo sapiens
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 36291 - protein, 576 aa, Homo sapiens; identical to SEQ ID NO: 36290

SEQ ID NO: 36292 - protein, 237 aa, Homo sapiens
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDV

SEQ ID NO: 36293 - protein, 698 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 36294 - protein, 527 aa, Homo sapiens
MVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 36295 - protein, 527 aa, Homo sapiens; identical to SEQ ID NO: 36294

SEQ ID NO: 36296 - protein, 698 aa, Homo sapiens; identical to SEQ ID NO: 36293

SEQ ID NO: 36297 - protein, 664 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 36298 - protein, 698 aa, Homo sapiens; identical to SEQ ID NO: 36293

SEQ ID NO: 36299 - protein, 720 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 36300 - protein, 720 aa, Homo sapiens; identical to SEQ ID NO: 36299

SEQ ID NO: 36301 - protein, 88 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTL

SEQ ID NO: 36302 - protein, 95 aa, Homo sapiens
MNNHVSSKPSTMKLKHTINPILLYFIHFLISLYTILTYIPFYFFSESRQEKSNRIKAKPVNSKPDSAYRSVNSLDGLASVLYPGCDTLDKVFTYA

SEQ ID NO: 36303 - protein, 683 aa, Homo sapiens
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 36304 - protein, 683 aa, Homo sapiens; identical to SEQ ID NO: 36303

SEQ ID NO: 36305 - protein, 739 aa, Homo sapiens
MDALKPPCLWRNHERGKKDRDSCGRKNSEPGSPHSLEALRDAAPSQGLNFLLLFTKMLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 36306 - protein, 465 aa, Homo sapiens
MLFPGASIVPECWLLVLIQNLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 36307 - protein, 683 aa, Homo sapiens; identical to SEQ ID NO: 36303

SEQ ID NO: 36308 - protein, 659 aa, Homo sapiens
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVKAIFLHPEPFSIENGLLTPTLKAKRGELSKYFRTQIDSLYEHIQD

SEQ ID NO: 36309 - protein, 722 aa, Homo sapiens
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36310 - protein, 622 aa, Homo sapiens
MQTQEILRILRLPELGDLGQFFRSLSATTLDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36311 - protein, 697 aa, Homo sapiens
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36312 - protein, 697 aa, Homo sapiens
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36313 - protein, 708 aa, Homo sapiens
MPEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36314 - protein, 667 aa, Homo sapiens
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTESQWAPTCADVHISYLPLAHMFERMVQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQDLPQCLIQIKVFSKY

SEQ ID NO: 36315 - protein, 722 aa, Homo sapiens
MLTFFLVSGGSLWLFVEFVLSLLEKMQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36316 - protein, 712 aa, Homo sapiens
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTGLSCQEGASATASTQADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36317 - protein, 697 aa, Homo sapiens; identical to SEQ ID NO: 36312

SEQ ID NO: 36318 - protein, 606 aa, Homo sapiens
MYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 36319 - protein, 228 aa, Homo sapiens [sequence omitted]

SEQ ID NO: 36320 - protein, 577 aa, Homo sapiens
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRLQLSKAKGIVTIDALASEVDSIASQCPSLKTKLLVSDHSREGWLDFRSLVKSASPEHTCVKSKTLDPMVIFFTSGTTGFPKMAKHSHGLALQPSFPGSRKLRSLKTSDVSWCLSDSGWIVATIWTLVEPWTAGCTVFIHHLPQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQVIDDKGSILPPNTEGNIGIRIKPVRPVSLFMCYEGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 36321 - protein, 577 aa, Homo sapiens; identical to SEQ ID NO: 36320

SEQ ID NO: 36322 - protein, 154 aa, Homo sapiens
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRL

SEQ ID NO: 36323 - protein, 577 aa, Homo sapiens
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRANDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 36324 - protein, 577 aa, Homo sapiens; identical to SEQ ID NO: 36323

SEQ ID NO: 36325 - protein, 498 aa, Homo sapiens
MWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRANDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 36326 - protein, 208 aa, Homo sapiens
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLKYKVRHRDVK

SEQ ID NO: 36327 - protein, 349 aa, Homo sapiens
MRHPPLITVWRLEAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRANDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 36328 - protein, 577 aa, Homo sapiens; identical to SEQ ID NO: 36323

SEQ ID NO: 36329 - protein, 577 aa, Homo sapiens
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 36330 - protein, 208 aa, Homo sapiens
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLKYKVRHREVK

SEQ ID NO: 36331 - protein, 586 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEVVKAFVVLNPDYKSHDQEQLIKEIQEHVKKTTAPYKYPRKVEFIQELPKTISGKTKRNELRKKEWKTI

SEQ ID NO: 36332 - protein, 438 aa, Homo sapiens
MLARVTRKMLRHAKCFQRLAIFGSVRALHKDNRTATPQNFSNYESMKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKVCTSPSRRMFNNPICTLPTYRLPPYKLSLL

SEQ ID NO: 36333 - protein, 578 aa, Homo sapiens
MKQDFKLGIPEYFNFAKDVLDQWTDKEKAGKKPSNPAFWWINRNGEEMRWSFEELGSLSRKFANILSEACSLQRGDRVILILPRVPEWWLANVACLRTGTVLIPGTTQLTQKDILYRLQSSKANCIITNDVLAPAVDAVASKCENLHSKLIVSENSREGWGNLKELMKVFLCHPGWSTVARSWLTATSTSLVQAILSLLSSWDYRHASDSHTCVKTKHNEIMAIFFTSGTSGYPKMTAHTHSSFGLGLSVNGRFWLDLTPSDVMWNTSDTGWAKSAWSSVFSPWIQGACVFTHHLPRFEPTSILQTLSKYPITVFCSAPTVYRMLVQNDITSYKFKSLKHCVSAGEPITPDVTEKWRNKTGLDIYEGYGQTETVLICGNFKGMKIKPGSMGKPSPAFDVKIVDVNGNVLPPGQEGDIGIQVLPNRPFGLFTHYVDNPSKTASTLRGNFYITGDRGYMDKDGYFWFVARADDVILSSGYRIGPFEVENALNEHPSVAESAVVSSPDPIRGEVVKAFVVLNPDYKSHDQEQLIKEIQEHVKKTTAPYKYPRKVEFIQELPKTISGKTKRNELRKKEWKTI

SEQ ID NO: 36334 - protein, 579 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNPDVREKWKHQTGVELYEGYGQSETVVICANPKGMKIKSGSMGKASPPYDVQIVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 36335 - protein, 689 aa, Homo sapiens [sequence omitted]

SEQ ID NO: 36336 - protein, 153 aa, Homo sapiens
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYSPWLQMPCGP

SEQ ID NO: 36337 - protein, 484 aa, Homo sapiens
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYRELLETTCRLANTLKRHGVHRGDRVAIYMPVSPLAVAAMLACARIGAVHTVIFAGFSAESLAGRINDVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 36338 - protein, 575 aa, Homo sapiens
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINILQIVGFFREAIRNSGDLLEH

SEQ ID NO: 36339 - protein, 606 aa, Homo sapiens
MLKTFLFLEKYFPCIKYSSACFPGTGLDVYDIKFAVLLHPQTALHFGPPPSLMAFSSLCCRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 36340 - protein, 568 aa, Homo sapiens
MRRRKERQPWDRFHFLHFAPHGRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 36341 - protein, 714 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQGKLKEKSKRVQPQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 36342 - protein, 651 aa, Homo sapiens
MMVRWALLCEFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 36343 - protein, 701 aa, Homo sapiens [sequence omitted]

SEQ ID NO: 36344 - protein, 699 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGRAELGMGDSTSQSPPIKRSCPDVQISWNQGIDLWWHELMQEAGDECEPEWCDAEHSSSCTPVAPQANPRVWFTQLGATCYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 36345 - protein, 409 aa, Homo sapiens
MQEAGDECEPEWCDAEDPLFILYTSGSTGKPKGVVHTVGGYMLYVATTFKYVFDFHAEDVFWCTADIGWITGHSYVTYGPLANGATSVLFEGIPTYPDVNRLWSIVDKYKVTKFYTAPTAIRLLMKFGDEPVTKHSRASLQVLGTVGEPINPEAWLWYHRVVGAQRCPIVDTFWQTETGGHMLTPLPGATPMKPGSATFPFFGVAPAILNESGEELEGEAEGYLVFKQPWPGIMRTVYGNHERFETTYFKKFPGYYVTGDGCQRDQDGYYWITGRIDDMLNVSGHLLSTAEVESALVEHEAVAEAAVVGHPHPVKGECLYCFVTLCDGHTFSPKLTEELKKQIREKIGPIATPDYIQNAPGLPKTRSGKIMRRVLRKIAQNDHDLGDMSTVADPSVISHLFSHRCLTIQ

SEQ ID NO: 36346 - protein, 37 aa, Homo sapiens
MMVRWALLCGECRILGRHCQGILLEDSMPWPIPSVQL

SEQ ID NO: 36347 - protein, 686 aa, Homo sapiens
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 36348 - protein, 368 aa, Homo sapiens
MLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 36349 - protein, 421 aa, Homo sapiens
MAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCRVRHERYFLPPGVRREPVRAGRVRGTLFLPPEPGPFPGIVDMFGTGGGLLEYRASLLAGKGFAVMALAYYNYEDLPKTMETLHLEYFEEAVNYLLSHPEVKGPGVGLLGISKGGELCLSMASFLKGITAAVVINGSVANVGGTLRYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 36350 - protein, 594 aa, Homo sapiens
MIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKVSYYNQATPGVLNYVTTNVAGLSSEFYTTFKACEQFLLDNRNDLAPSLQTL

SEQ ID NO: 36351 - protein, 607 aa, Homo sapiens
MIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKCCWVRVSLTELVSASGFYSWGLESRSKGRRSDGWNGKLAGGHLSTLKAIPVAKINSRFGYLQDT

SEQ ID NO: 36352 - protein, 555 aa, Homo sapiens
MERPAPGEVVMSQAIQPAHATARGELSAGQLLKWIDTTACLAAEKHAGVSCVTASVDDIQFEETARVGQVITIKAKVTRAFSTSMEISIKVMVQDMLTGIEKLVSVAFSTFVAKPVGKEKIHLKPVTLLTEQDHVEHNLAAERRKVRLQHEDTFNNLMKESSKFDDLIFDEEEGAVSTRGTSVQSIELVLPPHANHHGNTFGGQIMAWMETVATISASRLCWAHPFLKSVDMFKFRGPSTVGDRLVFTAIVNNTFQTCVEVGVRVEAFDCQEWAEGRGRHINSAFLIYNAADDKENLITFPRIQPISKDDFRRYRGAIARKRIRLGRKYVISHKEEVPLCIHWDISKQASLSDSNVEALKKLAAKRGWEVTSTVEKIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSYFNHMSASILPYFAGNLGGWSKSIEETAASCIQFLENPPDDGFVSTF

SEQ ID NO: 36353 - protein, 483 aa, Homo sapiens
MSNKLLSPHPHSVVLRSEFKMASSPAVLRASRLYQWSLKSSAQFLGSPQLRQVGQIIRVPARMAATLILEPAGRCCWDEPVRIAVRGLAPEQPVTLRASLRDEKGALFQAHARYRADTLGELDLERAPALGGSFAGLEPMGLLWALEPEKPLVRLVKRDVRTPLAVELEVLDGHDPDPGRLLCQTRHERYFLPPGVRREPVRVGRVRGTLFLPPEPGPFPGIVDMFGTGGGLLEYRASLLAGKGFAVMALAYYNYEDLPKTMETLHLEYFEEAMNYLLSHPEVKGPGVGLLGISKGGELCLSMASFLKGITAAVVINGSVANVGGTLHYKGETLPPVGVNRNRIKVTKDGYADIVDVLNSPLEGPDQKSFIPVERAESTFLFLVGQDDHNWKSEFYANEACKRLQAHGRRKPQIICYPETGHYIEPPYFPLCRASLHALVGSPIIWGGEPRAHAMAQVDAWKQLQTFFHKHLGGHEGTIPSKV

SEQ ID NO: 36354 - protein, 421 aa, Homo sapiens
MSATLILEPPGRCCWNEPVRIAVRGLAPEQRVTLRASLRDEKGALFRAHARYCADARGELDLERAPALGGSFAGLEPMGLLWALEPEKPFWRFLKRDVQIPFVVELEVLDGHDPEPGRLLCQAQHERHFLPPGVRRQSVRAGRVRATLFLPPGPGPFPGIIDIFGIGGGLLEYRASLLAGHGFATLALAYYNFEDLPNNMDNISLEYFEEAVCYMLQHPQVKGPGIGLLGISLGADICLSMASFLKNVSATVSINGSGISGNTAINYKHSSIPPLGYDLRRIKVAFSGLVDIVDIRNALVGGYKNPSMIPIEKAQGPILLIVGQDDHNWRSELYAQTVSERLQAHGKEKPQIICYPGTGHYIEPPYFPLCPASLHRLLNKHVIWGGEPRAHSKAQEDAWKQILAFFCKHLGGTQKTAVPKL

SEQ ID NO: 36355 - protein, 207 aa, Homo sapiens
MLQHPKVKGPSIALLGFSKGGDLCLSMASFLKGITATVLINACVANTVAPLHYKDMIIPKLVDDLGKVKITKSGFLTFMDTWSNPLEEHNHQSLVPLEKAQVPFLFIVGMDDQSWKSEFYAQIASERLQAHGKERPQIICYPETGHCIDPPYFPPSRASVHAVLGEAIFYGGEPKAHSKAQVDAWQQIQTFFHKHLNGKKSVKHSKI

SEQ ID NO: 36356 - protein, 168 aa, Homo sapiens
MLQHPKVKGPSIALLGFSKGGDLCLSMASFLKGITATVLINACVANTVAPLHYKDMIIPKLVDDLGKVKITKSGFLTFMDTWSNPLEEHNHQSLVPLEKAQVPFLFIVGMDDQSWKSEFYAQIASERLQAHGKERPQIICYPETGHCIDPPYFPPSRASVHAVLGEAI

SEQ ID NO: 36357 - protein, 370 aa, Homo sapiens
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 36358 - protein, 329 aa, Homo sapiens
MAFQLSRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 36359 - protein, 350 aa, Homo sapiens
MLLLRRSLSLNVLRKEVDRACFGEKAKQIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 36360 - protein, 380 aa, Homo sapiens
MKLLARALRLCEFGRQASSRRLVAGQGCVGPRRGCCAPVQVVGPRADLPPCGACITGRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 36361 - protein, 223 aa, Homo sapiens
MLLLRRSLSLNVLRKEVDRACFGEKAKQIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGGVDFH

SEQ ID NO: 36362 - protein, 265 aa, Homo sapiens
MCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 36363 - protein, 319 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGEGDMKMHCCVAAYISDYAFLGTALLPHQWQHKVHFMVSLDHSMWFHAPFRADHWMLYECESPWAGGSRGLVHGRLWRQDGVLAVTCAQEGVIRVKPQVSESKL

SEQ ID NO: 36364 - protein, 113 aa, Homo sapiens
MSSPQAPEDGQGCGDRGDPPGDLRSVLVTTVLNLEPLDEDLFRGRHYWVPAKRLFGGQIVGQALVAAAKSVSEDVHVHSLHCYFVRAEQMPSCVLRRSPAEKSLWTFTVCDLY

SEQ ID NO: 36365 - protein, 439 aa, Homo sapiens
MRRAALRLCALGKGQLTPGRGLTQGPQNPKKQGIFHIHEVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 36366 - protein, 379 aa, Homo sapiens
MEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 36367 - protein, 448 aa, Homo sapiens
MRRAALRLCALGKGQLTPGRGLTQGPQNPKKQGIFHIHEACSSIHVNHVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 36368 - protein, 422 aa, Homo sapiens
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 36369 - protein, 65 aa, Homo sapiens
MTVFFKTLRNHWKKTTAGLCLLTWGGHWLYGKHCDNLLRRAACQEAQHYQDESRWEPTLSRTPGS

SEQ ID NO: 36370 - protein, 65 aa, Homo sapiens; identical to SEQ ID NO: 36369

SEQ ID NO: 36371 - protein, 244 aa, Homo sapiens
MTVFFKTLRNHWKKTTAGLCLLTWGGHWLYGKHCDNLLRRAACQEAQVFGNQLIPPNAQVKKATVFLNPAACKGTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKPFPKR

SEQ ID NO: 36372 - protein, 575 aa, Homo sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 36373 - protein, 543 aa, Homo sapiens
MQSPWKILTVAPLFLLLSLQSSASPANDDQSRPSLSNGHTCVEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 36374 - protein, 297 aa, Homo sapiens [sequence omitted]

SEQ ID NO: 36375 - protein, 686 aa, Homo sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNERKSILLKGILMTSQTLDNQEWTQLTSWIKGNLTCDSRTREWLCCCWRIISGKRCSSSGPKSWERRIRSTPRLNRCLETKAGTEPLRSMHPWGAQGGRGLGKLIPQLWGLPRHRPKGLFFSSIFKCLSLNEEHIWTTVQCCVLPGSVTLPLFLK

SEQ ID NO: 36376 - protein, 663 aa, Homo sapiens
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNERKSILLKGILMTSQTLDNQEWTQLTSWIKGNLTCDSRTREWLCCCWRIISGKRCSSSGPKSWERRIRSTPRLNRCLETKAGTEPLRSMHPWGAQGGRGLGKLIPQPYGGCHVTGPKDSSSAASLQMSFSQ

SEQ ID NO: 36377 - protein, 99 aa, Homo sapiens
MAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 36378 - protein, 55 aa, Homo sapiens
MAEGNTLISVDYEIFGKVQGVFFRKHTQEMTVENRIAETHSKSCVPVSFATSYAG

SEQ ID NO: 36379 - protein, 99 aa, Homo sapiens; identical to SEQ ID NO: 36377

SEQ ID NO: 36380 - protein, 99 aa, Homo sapiens
MSTAQSLKSVDYEVFGRVQGVCFRMYTEDEARKIGVVGWVKNTSKGTVTGQVQGPEDKVNSMKSWLSKVGSPSSRIDRTNFSNEKTISKLEYSNFSIRY

SEQ ID NO: 36381 - protein, 97 aa, Homo sapiens
MCPLPLAAAAVAAPRAPLRLLNRGLAAAMSTAQSLKSVDYEVFGRVQGVCFRMYTEDEARKIGVVGWVKNTSKGTVTGQVQGPEDKVNSMLECSGLI

SEQ ID NO: 36382 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 36383 - protein, 447 aa, Homo sapiens
MVLLRVLILLLSWAAGMGDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 36384 - protein, 769 aa, Homo sapiens
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 36385 - protein, 523 aa, Homo sapiens
CWGSGHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQPQQGRAVWLPPLCQHLWSSSARGPGGRHQ

SEQ ID NO: 36386 - protein, 569 aa, Homo sapiens
MQGTRLPVCCACPVGSSKPAEAEKEKVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 36387 - protein, 738 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 36388 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 36389 - protein, 278 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFT

SEQ ID NO: 36390 - protein, 814 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 36391 - protein, 839 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQSQGPAKPPPPRKPLPADPQGRCPSGDLPGPGAGIPPLVVPSRPAPPPPTVSSLYL

SEQ ID NO: 36392 - protein, 863 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 36393 - protein, 838 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKAELADRPNPPTRPLPADPVVRSPKSQGPAKPPPPRKPLPADPQGRCPSGDLPGPGAGIPPLVVPSRPAPPPPTVSSLYL

SEQ ID NO: 36394 - protein, 772 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYSLRGQPSPHPQGSHCLPTPRAGAHRVTCPAQGLESRP

SEQ ID NO: 36395 - protein, 520 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRSFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 36396 - protein, 862 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 36397 - protein, 796 aa, Homo sapiens
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRLVLSASRPPLPGRCRLTLCPRDSSLRGQPSPHPQGSHCLPTPRAGAHRVTCPAQGLESRP

SEQ ID NO: 36398 - protein, 824 aa, Homo sapiens
MRLALLWALGLLGAGSPLPSWPLPNIVLSWGVLGPAGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKSQGPAKPPPPRKPLPADPQGRCPSGDLPGPGAGIPPLVVPSRPAPPPPTVSSLYL

SEQ ID NO: 36399 - protein, 918 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 36400 - protein, 920 aa, Homo sapiens
MPGGAGAARLCLLAFALQPLRPRAAREPGWTISRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 36401 - protein, 638 aa, Homo sapiens
MCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQKCLLPPAMILRAPQPSGTVVCLVISFNMAFYRSMRIRIEPGIKTKLLVLLVWKQF

SEQ ID NO: 36402 - protein, 955 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 36403 - protein, 735 aa, Homo sapiens
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 36404 - protein, 716 aa, Homo sapiens
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 36405 - protein, 776 aa, Homo sapiens
MVQLHQDTDPQIPKGQPCTLNSSEGGARPAVPHTLFSSALDRWLHNDSFIMAVGEPLVHIRVTLLLLWFGMFLSISGHSQARPSQYFTSPEVVIPLKVISRGRGAKAPGWLSYSLRFGGQRYIVHMRVNKLLFAAHLPVFTYTEQHALLQDQPFIQDDCYYHGYVEGVPESLVALSTCSGGFLGMLQINDLVYEIKPISVSATFEHLVYKIDSDDTQFPPMRCGLTEEKIAHQMELQLSYNFTLKQSSFVGWWTHQRFVELVVVVDNIRYLFSQSNATTVQHEVFNVVNIVDSFYHPLEVDVILTGIDIWTASNPLPTSGDLDNVLEDFSIWKNYNLNNRLQHDVAHLFIKDTQGMKLGVAYVKGICQNPFNTGVDVFEDNRLVVFAITLGHELGHNLGMQHDTQWCVCELQWCIMHAYRKVTTKFSNCSYAQYWDSTISSGLCIQPPPYPGNIFRLKYCGNLVVEEGEECDCGTIRQCAKDPCCLLNCTLHPGAACAFGICCKDCKFLPSGTLCRQQVGECDLPEWCNGTSHQCPDDVYVQDGISCNVNAFCYEKTCNNHDIQCKEIFGQDARSASQSCYQEINTQGNRFGHCGIVGTTYVKCWTPDIMCGRVQCENVGVIPNLIEHSTVQQFHLNDTTCWGTDYHLGMAIPDIGEVKDGTVCGPEKICIRKKCASMVHLSQACQPKTCNMRGICNNKQHCHCNHEWAPPYCKDKGYGGSADSGPPPKNNMEGLNVMGKLRYLSLLCLLPLVAFLLFCLHVLFKKRTKSKEDEEG

SEQ ID NO: 36406 - protein, 722 aa, Homo sapiens
MAVDGTLVYIRVTLLLLWLGVFLSISGYCQAGPSQHFTSPEVVIPLKVISRGRSAKAPGWLSYSLRFGGQKHVVHMRVKKLLVSRHLPVFTYTDDRALLEDQLFIPDDCYYHGYVEAAPESLVVFSACFGGFRGVLKISGLTYEIEPIRHSATFEHLVYKINSNETQFPAMRCGLTEKEVARQQLEFEEAENSALEPKSAGDWWTHAWFLELVVVVNHDFFIYSQSNISKVQEDVFLVVNIVDSMYKQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRGVFLPLIVIPSLSVLTFLFTVGLLMYLRQCSGPKETKAHSSG

SEQ ID NO: 36407 - protein, 906 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 36408 - protein, 899 aa, Homo sapiens [sequence omitted]

SEQ ID NO: 36409 - protein, 859 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTE

SEQ ID NO: 36410 - protein, 870 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 36411 - protein, 899 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTEYLNPWFKRDYNVAKWVEDVNKNTEGPYFRTLSPAKSPSSSTGSIASSRKYPYPMPPLPDEDKKVNRQSARLWETSI

SEQ ID NO: 36412 - protein, 775 aa, Homo sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPVSTPKDSNPKA

SEQ ID NO: 36413 - protein, 483 aa, Homo sapiens
MEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFRRLLHCGWGAVPNGGHFCGGCYGNPAPELQRKAEERSEATIYHWHQATQTEEETPDGKGCSTPRDESDEAPCV

SEQ ID NO: 36414 - protein, 540 aa, Homo sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGRRTNPFPCACAKENHFR

SEQ ID NO: 36415 - protein, 307 aa, Homo sapiens
MANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGRRTNPFPCACAKENHFR

SEQ ID NO: 36416 - protein, 820 aa, Homo sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 36417 - protein, 820 aa, Homo sapiens; identical to SEQ ID NO: 36416

SEQ ID NO: 36418 - protein, 820 aa, Homo sapiens; identical to SEQ ID NO: 36416

SEQ ID NO: 36419 - protein, 44 aa, Homo sapiens
MKMLLLLHCLGVFLSCSGHIQDEHPQYHSPPDVVIPVRITGTTR

SEQ ID NO: 36420 - protein, 90 aa, Homo sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAIL

SEQ ID NO: 36421 - protein, 14 aa, Homo sapiens
MKMLLLLHCLGVFL

SEQ ID NO: 36422 - protein, 820 aa, Homo sapiens; identical to SEQ ID NO: 36416

SEQ ID NO: 36423 - protein, 790 aa, Homo sapiens
MRSVQIFLSQCRLLLLLVPTMLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKAKTGQEESKANIESKRPKAKSVKKQKK

SEQ ID NO: 36424 - protein, 781 aa, Homo sapiens
MRSVQIFLSQCRLLLLLVPTMLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKANIESKRPKAKSVKKQKK

SEQ ID NO: 36425 - protein, 179 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNQLLAPGYIETHYGPDGQPVVLAPNHTVRCFHGLWDAPPEGRREARRTRKYLELYIVADHTLFLTRHRNLNHTKQRLLEVANYVDQVVNSAGDAHG

SEQ ID NO: 36426 - protein, 111 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNQLLAPGYIETHYGPAQECRDLCCFAHN

SEQ ID NO: 36427 - protein, 787 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 36428 - protein, 813 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 36429 - protein, 138 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTVRCFHGLWDAPPEVPPHHSYPYSSLHS

SEQ ID NO: 36430 - protein, 180 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNQLLAPGYIETHYGPDGQPVVLAPNHTVRCFHGLWDAPPEGRREARRTRKYLELYIVADHTLFLTRHRNLNHTKQRLLEVANYVDQECRDLCCFAHN

SEQ ID NO: 36431 - protein, 812 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 36432 - protein, 151 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNQDALCGKLQCQGGKPSLLAPHMVPVDSTVHLDGQEVTCRGALALPSAQLDLLGLGLVEPGTQCGPRM

SEQ ID NO: 36433 - protein, 692 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQDQVQMPRSCLW

SEQ ID NO: 36434 - protein, 173 aa, Homo sapiens [sequence omitted]

SEQ ID NO: 36435 - protein, 96 aa, Homo sapiens
MGWRPRRARGTPLLLLLLLLLLWPVPGAGVLQGHIPGQPVTPHWVLDGQPWRTVSLEEPVSKPDMGLVALEAEGQELLLELEKNQFAIATITATVL

SEQ ID NO: 36436 - protein, 754 aa, Homo sapiens
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 36437 - protein, 551 aa, Homo sapiens
VCPRSYFLEGRGSYSFLSLFSTSPAPYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLN

SEQ ID NO: 36438 - protein, 824 aa, Homo sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 36439 - protein, 733 aa, Homo sapiens
MRGLGLWLLGAMMLPGPAPREGELRPWGHRAQLHPPPAEEQGPAGLRLHRDLYGCQWLRGDGAASRAGPLLLPGPRRGVPGLSRQPQHLCRPQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQGAVGPKVALKPPIQRKQGAGAPTAP

SEQ ID NO: 36440 - protein, 742 aa, Homo sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAGCQPRAGQGRGSSPIQGPPRAGPHHPPGPARPTPGLLGGSEEAAPCSSGHCVQPTLPSSCLHPAGTKAGHQANVRTPSAPSQTRGWCGQPWSS

SEQ ID NO: 36441 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 36442 - protein, 967 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 36443 - protein, 1103 aa, Homo sapiens
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASTSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 36444 - protein, 847 aa, Homo sapiens
QDDGGLSRAPGCGAVCPGHHEHCQVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSEVSRPLPSRPLGCPGGVSTETPLRGLQVSCPLLTSHWGSTLSTKRPFQLQCTPSCGPGLRHRVVLCKSADHRATLPPAHCSPAAKPPATMRCNLRRCPPARWVAGEWGECSAQCGVGQRQRSVRCTSHTGQASHECTEA

SEQ ID NO: 36445 - protein, 1509 aa, Homo sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 36446 - protein, 1594 aa, Homo sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPAHPCELYCRPIDGQFSEKMLDAVIDGTPCFEGGNSRNVCINGICKMVGCDYEIDSNATEDRCGVCLGDGSSCQTVRKMFKQKEGSGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 36447 - protein, 232 aa, Homo sapiens
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKGIVTHMSSWVEESVLFFWLFY

SEQ ID NO: 36448 - protein, 1224 aa, Homo sapiens
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDLKFQVNMSFCNPKTRPVTGLVPCKVSACPPSWSVGNWSACSRTCGGGAQSRPVQCTRRVHYDSEPVPASLCPQPAPSSRQACNSQSCPPAWSAGPWAECSHTCGKGWRKRAVACKSTNPSARAQLLPDAVCTSEPKPRMHEACLLQRCHKPKKLQWLVSAWSQCSVTCERGTQKRFLKCAEKYVSGKYRELASKKCSHLPKPSLELERACAPLPCPRHPPFAAAGPSRGSWFASPWSQCTASCGGGVQTRSVQCLAGGRPASGCLLHQKPSASLACNTHFCPIAEKKDAFCKDYFHWCYLVPQHGMCSHKFYGKQCCKTCSKSNL

SEQ ID NO: 36449 - protein, 928 aa, Homo sapiens
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDFLYFMFYLSQLFASECPFKNTLLHAFLCK

SEQ ID NO: 36450 - protein, 1095 aa, Homo sapiens
MCDGALLPPLVLPVLLLLVWGLDPGTAVGDAAADVEVVLPWRVRPDDVHLPPLPAAPGPRRRRRPRTPPAAPRARPGERALLLHLPAFGRDLYLQLRRDLRFLSRGFEVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKINIQVTKLVLLRQRPAKLSIGHHGERSLESFCHWQNEEYGGARYLGNNQVPGGKDDPPLVDAAVFVTRTDFCVHKDEPCDTVGIAYLGGVCSAKRKCVLAEDNGLNLAFTIAHELGHNLGMNHDDDHSSCAGRSHIMSGEWVKGRNPSDLSWSSCSRDDLENFLKSKVSTCLLVTDPRSQHTVRLPHKLPGMHYSANEQCQILFGMNATFCRNMEHLMCAGLWCLVEGDTSCKTKLDPPLDGTECGADKWCRAGECVSKTPIPEHVDGDWSPWGAWSMCSRTCGTGARFRQRKCDNPPPGPGGTHCPGASVEHAVCENLPCPKGLPSFRDQQCQAHDRLSPKKKGLLTAVVVDDKPCELYCSPLGKESPLLVADRVLDGTPCGPYETDLCVHGKCQKIGCDGIIGSAAKEDRCGVCSGDGKTCHLVKGDFSHARGTALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGGERRTIVSCTRIVNKTTTLVNDSDCPQASRPEPQVRRCNLHPCQSRWVAGPWSPCSATCEKGFQHREVTCVYQLQNGTHVATRPLYCPGPRPAAVQSCEGQDCLSIWEASEWSQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPNS

SEQ ID NO: 36451 - protein, 1221 aa, Homo sapiens
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKYAPKPPTEDTYLRFDEYGSSGRPRRSAGKSQKGLNVETLVVADKKMVEKHGKGNVTTYILTVMNMVSGLFKDGTIGSDINVVVVSLILLEQEPGGLLINHHADQSLNSFCQWQSALIGKNGKRHDHAILLTGFDICSWKNEPCDTLGFAPISGMCSKYRSCTINEDTGLGLAFTIAHESGHNFGMIHDGEGNPCRKAEGNIMSPTLTGNNGVFSWSSCSRQYLKKFLSTPQAGCLVDEPKQAGQYKYPDKLPGQIYDADTQCKWQFGAKAKLCSLGFVKDICKSLWCHRVGHRCETKFMPAAEGTVCGLSMWCRQGQCVKFGELGPRPIHGQWSAWSKWSECSRTCGGGVKFQERHCNNPKPQYGGLFCPGSSRIYQLCNINPCNENSLDFRAQQCAEYNSKPFRGWFYQWKPYTKVEEEDRCKLYCKAENFEFFFAMSGKVKDGTPCSPNKNDVCIDGVCELVGCDHELGSKAVSDACGVCKGDNSTCKFYKGLYLNQHKANEYYPVVLIPAGARSIEIQELQVSSSYLAVRSLSQKYYLTGGWSIDWPGEFPFAGTTFEYQRSFNRPERLYAPGPTNETLVFEILMQGKNPGIAWKYALPKVMNGTPPATKRPAYTWSIVQSECSVSCGGGYINVKAICLRDQNTQVNSSFCSAKTKPVTEPKICNAFSCPAYWMPGEWSTCSKACAGGQQSRKIQCVQKKPFQKEEAVLHSLCPVSTPTQVQACNSHACPPQWSLGPWSQCSKTCGRGVRKRELLCKGSAAETLPESQCTSLPRPELQEGCVLGRCPKNSRLQWVASSWSECSATCGLGVRKREMKCSEKGFQGKLITFPERRCRNIKKPNLDLEETCNRRACPAHPVYNMVAGWYSLPWQQCTVTCGGGVQTRSVHCVQQGRPSSSCLLHQKPPVLRACNTNFCPAPEKREDPSCVDFFNWCHLVPQHGVCNHKFYGKQCCKSCTRKI

SEQ ID NO: 36452 - protein, 274 aa, Homo sapiens
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKCICSQASHRGHLSKV

SEQ ID NO: 36453 - protein, 1211 aa, Homo sapiens
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 36454 - protein, 566 aa, Homo sapiens
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKFRPGAVAHACYPSTLGGQGRWIA

SEQ ID NO: 36455 - protein, 1504 aa, Homo sapiens
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTESYNIDCNCVLKAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKEILIEVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 36456 - protein, 1910 aa, Homo sapiens
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSCSASCGKGRKYREVFCIDQFQRKLEDTNCSQVQKPPTHKACRSVRCPSWKANSWNECSVTCGSGVQQRDVYCRLKGVGQVVEEMCDQSTRPCSQRRCWSQDCVQHKGMERGRLNCSTSCERKDSHQRMECTDNQIRQVNEIVYNSSTISLTSKNCRNPPCNYIVVTADSSQCANNCGFSYRQRITYCTEIPSTKKHKLHRLRPIVYQECPVVPSSQVYQCINSCLHLATWKVGKWSKCSVTCGIGIMKRQVKCITKHGLSSDLCLNHLKPGAQKKCYANDCKSFTTCKEIQVKNHIRKDGDYYLNIKGRIIKIYCADMYLENPKEYLTLVQGEENFSEVYGFRLKNPYQCPFNGSRREDCECDNGHLAAGYTVFSKIRIDLTSMQIKTTDLLFSKTIFGNAVPFATAGDCYSAFRCPQGQFSINLSGTGMKISSTAKWLTQGSYTSVSIRRSEDGTRFFGKCGGYCGKCLPHMTTGLPIQVI

SEQ ID NO: 36457 - protein, 622 aa, Homo sapiens
MFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 36458 - protein, 1504 aa, Homo sapiens
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKELILQVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSEDLKVKLLPQRTIILWELMKNIFCHGKHSHMYLINVVTDHLLYPRHCDPETIETYFLSLWSLQFTWGDLKYYKNSL

SEQ ID NO: 36459 - protein, 1205 aa, Homo sapiens
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRRTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 36460 - protein, 339 aa, Homo sapiens
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQVRPQSAPQAMHCTILRSATT

SEQ ID NO: 36461 - protein, 837 aa, Homo sapiens
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQAQALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 36462 - protein, 930 aa, Homo sapiens
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDGSPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRLYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 36463 - protein, 858 aa, Homo sapiens
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCRKVMKQQYGSSHYCEYQSFFLVCLQSRLHHQLSREVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGKMPTRQPTQRARWRTKHILSYALCLLKKLIGNISCRFASSCNLAKETLL

SEQ ID NO: 36464 - protein, 1117 aa, Homo sapiens
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLDSGRGTCLDNEPPKRDFLYPAVAPGQVYDADEQCRFQYGATSRQCKYGEVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGVQRQEVVCKRLDDNSIVQNNYCDPDSKPPENQRACNTEPCPPEWFIGDWLECSKTCDGGMRTRAVLCIRKIGPSEEETLDYSGCLTHRPVEKEPCNNQSCPPQWVALDWSECTPKCGPGFKHRIVLCKSSDLSKTFPAAQCPEESKPPVRIRCSLGRCPPPRWVTGDWGQCSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 36465 - protein, 468 aa, Homo sapiens
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLEFLKLGDSISGS

SEQ ID NO: 36466 - protein, 1686 aa, Homo sapiens
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAEKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNAGWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSGPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 36467 - protein, 460 aa, Homo sapiens
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSSCTTPLPSPGPAAAASISPGSLSVQRQNVYCLERQAGPVDEEHCDPLGRPDDQQRKCSEQPCPASAQ

SEQ ID NO: 36468 - protein, 889 aa, Homo sapiens
MLPAPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 36469 - protein, 918 aa, Homo sapiens
AARARLGGGGAGGAGCASQRGRRGSAPAAGPRGPSRPCTRLIPLFLERAAGPRSGRQHLPAPGGLLPSPARSHRRSPHAPRPRRPPVASAPAAAAAAAAAGPRRPGPARSRGAGLGAGGAHAVARLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 36470 - protein, 1907 aa, Homo sapiens
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 36471 - protein, 991 aa, Homo sapiens
  MOD_RES (1)..(1): Any amino acid
XECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 36472 - protein, 1935 aa, Homo sapiens
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 36473 - protein, 391 aa, Homo sapiens
MILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 36474 - protein, 470 aa, Homo sapiens
MLRGISQLPAVATMSWVLLPVLWLIVQTQAIAIKQTPELTLHEIVCPKKLHILHKREIKNNQTEKHGKEERYEPEVQYQMILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 36475 - protein, 391 aa, Homo sapiens; identical to SEQ ID NO: 36473

SEQ ID NO: 36476 - protein, 683 aa, Homo sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARSSIDSAWNACNVLC

SEQ ID NO: 36477 - protein, 466 aa, Homo sapiens
MCLTDEWGFFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 36478 - protein, 525 aa, Homo sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPS

SEQ ID NO: 36479 - protein, 261 aa, Homo sapiens
MCLTDEWGFFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRAMGLASGLT

SEQ ID NO: 36480 - protein, 1762 aa, Homo sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQGGWPGELLASWEAQDSAERNTTSEEDPGAEQVLLHLPFTMVTEQRRLDDILGNLSQQPEELRDLYSKHLVAQLAQEIFRSHLEHQDTLLKPSERRTSPVTLSPHKHVSGFSSSLRTSSTGDAGGGSRRPHRKPTILRKISAAQQLSASEVVTHLGQTVALASGTLSVLLHCEAIGHPRPTISWARNGEEVQFSDRILLQPDDSLQILAPVEADVGFYTCNATNALGYDSVSIAVTLAGKPLVKTSRMTVINTEKPAVTVDIGSTIKTVQGVNVTINCQVAGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 36481 - protein, 439 aa, Homo sapiens
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPARWEATPWTACSSSCGGGIQSRAVSCVEEDIQGHVTSVEEWKCMYTPKMPIAQPCNIFDCPKWLAQEWSPVTVPSFFVH

SEQ ID NO: 36482 - protein, 951 aa, Homo sapiens
MDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 36483 - protein, 951 aa, Homo sapiens; identical to SEQ ID NO: 36482

SEQ ID NO: 36484 - protein, 1060 aa, Homo sapiens
MLFEVGEGGGAGEEGKGRGRPGRSLCTHAAPARTAHLAPSALRSARPFLWEDNLLTRSQGLPDNHDQLVPDNLEAWALAGPRGLFPKRTLVIWKRIGAGLVVTVALLPRMDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 36485 - protein, 1691 aa, Homo sapiens
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 36486 - protein, 1074 aa, Homo sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 36487 - protein, 1074 aa, Homo sapiens; identical to SEQ ID NO: 36486

SEQ ID NO: 36488 - protein, 1097 aa, Homo sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEAPLLPLRHAFFLLPGAGSGDSTGVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 36489 - protein, 877 aa, Homo sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKVSPEPPAISCILGNHAQDTSAFPA

SEQ ID NO: 36490 - protein, 436 aa, Homo sapiens
MGSLALAGVLMAVESVGVMILPVALFRGTSLTEGAPWAIRRSCGFQREPCGSRLPSSGLAPTTWHFVALGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPP

SEQ ID NO: 36491 - protein, 709 aa, Homo sapiens
MPGIDKLPIEETLEDSPQTRSLLGVFEEDATAISNYMNQLYQAMHRIYDAQNELSAATHLTSKLLKEYEKQRFPLGGDDEVMSSTLQQFSKVIDELSSCHAVLSTQLADAMMFPITQFKERDLKEILTLKEVFQIASNDHDAAINRYSRLSKKRENDKVKYEVTEDVYTSRKKQHQTMMHYFCALNTLQYKKKIALLEPLLGYMQAQISFFKMGSENLNEQLEEFLANIGTSVQNVRREMDSDIETMQQTIEDLEVASDPLYVPDPDPTKFPVNRNLTRKAGYLNARNKTGLVSSTWDRQFYFTQGGNLMSQARGDVAGGLAMDIDNCSVMAVDCEDRRYCFQITSFDGKKSSILQAESKKDHEEWICTINNISKQIYLSENPEETAARVNQSALEAVTPSPSFQQRHESLRPAAGQSRPPTARTSSSGSLGSESTNLAALSLDSLVAPDTPIQFDIISPVCEDQPGQAKAFGQGGRRTNPFGESGGSTKSETEDSILHQLFIVRFLGSMEVKSDDHPDVVYETMRQILAARAIHNIFRMTESHLLVTCDCLKLIDPQTQVTRLTFPLPCVVLYATHQENKRLFGFVLRTSSGRSESNLSSVCYIFESNNEGEKICDSVGLAKQIALHAELDRRASEKQKEIERVKEKQQKELNKQKQIEKDLEEQSRLIAASSRPNQASSEGQFVVLSSSQSEESDLGEGGKKRESEA

SEQ ID NO: 36492 - protein, 664 aa, Homo sapiens
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 36493 - protein, 670 aa, Homo sapiens
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNDVCLFLEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 36494 - protein, 919 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVGSISMDLQLTNKALQVMTDFAIQFNRNSFGLAPATPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTLSLKCRAPEVSQHVYQAYETILKN

SEQ ID NO: 36495 - protein, 942 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPATPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 36496 - protein, 949 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLMGDEPEGIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPATPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 36497 - protein, 939 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPATPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTLSLKCRAPEVSQHVYQAYETILKN

SEQ ID NO: 36498 - protein, 949 aa, Homo sapiens; identical to SEQ ID NO: 36496

SEQ ID NO: 36499 - protein, 939 aa, Homo sapiens; identical to SEQ ID NO: 36497

SEQ ID NO: 36500 - protein, 578 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPP

SEQ ID NO: 36501 - protein, 939 aa, Homo sapiens; identical to SEQ ID NO: 36497

SEQ ID NO: 36502 - protein, 822 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 36503 - protein, 825 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKNEKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 36504 - protein, 825 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKESKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 36505 - protein, 565 aa, Homo sapiens
MFGSCCHCCRRPRSCWFHSRFRAVSGVQSQAVGVEKRRQRSWARRGREPQGLLRLLEGRPRGLGPGGSARRGVPCCGVAPPRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKESKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSPTFGTSGCMVYR

SEQ ID NO: 36506 - protein, 845 aa, Homo sapiens
MEKNINLRNCQTLNTYVMLTHLRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 36507 - protein, 176 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKEMIYKQTNVTGYILGGIPNS

SEQ ID NO: 36508 - protein, 348 aa, Homo sapiens
MKDKMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAVPKTFQLQLLSPSSSIVPAFNTGTITQVIKVLNPQKQQLRMRIKLTYNHKGSAMQDLAEVNNFPPQSWQ

SEQ ID NO: 36509 - protein, 423 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 36510 - protein, 370 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKGGKEYLMRAHFGLPSVEAEDKEGKPPISVKFEIPYFTTSGIQVRYLKIIEKSGYQALPWVRYITQNGDYQLRTQ

SEQ ID NO: 36511 - protein, 435 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLGKYPGVGWLGHTVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 36512 - protein, 351 aa, Homo sapiens [sequence omitted]

SEQ ID NO: 36513 - protein, 423 aa, Homo sapiens
MSASAVFILDVKGKPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGRSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 36514 - protein, 158 aa, Homo sapiens
MMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEKAYFILDEFLMGGDVQDTSKKSVLKAIEQADLLQEEDESPRSVLEEMGLA

SEQ ID NO: 36515 - protein, 158 aa, Homo sapiens; identical to SEQ ID NO: 36514

SEQ ID NO: 36516 - protein, 157 aa, Homo sapiens
MQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEEAETPRSVLEEIGLT

SEQ ID NO: 36517 - protein, 153 aa, Homo sapiens
MLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQESQNEEWGGLSEDIL

SEQ ID NO: 36518 - protein, 160 aa, Homo sapiens
MQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEKTETMYHSKSFIGFKKAY

SEQ ID NO: 36519 - protein, 202 aa, Homo sapiens
MPAGCPPHSTTASLPQHGDRGFPFAAAAAAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEKTETMYHSKSFIGFKKAY

SEQ ID NO: 36520 - protein, 146 aa, Homo sapiens
  MOD_RES (1)..(1): Any amino acid
XRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEPRHEYFNVPVY

SEQ ID NO: 36521 - protein, 153 aa, Homo sapiens
  MOD_RES (1)..(1): Any amino acid
XLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQESQNEEWGGLSEDIL

SEQ ID NO: 36522 - protein, 195 aa, Homo sapiens
MPAGCPPHSTTASLPQHGDRGFPFAAAAAAGQAPPRPRPAAAMQFMLLFSRQGKLRLQKWYVPLSDKEKKKITRELVQTVLARKPKMCSFLEWRDLKIVYKRYASLYFCCAIEDQDNELITLEIIHRYVELLDKYFGSVCELDIIFNFEKAYFILDEFLLGGEVQETSKKNVLKAIEQADLLQEPRHEYFNVPVY

SEQ ID NO: 36523 - protein, 104 aa, Homo sapiens
MIRFILIQNRAGKTRLAKWYMQFDDDEKQKLIEEVHAVVTVRDAKHTNFVEVLNEYFHNVCELDLVFNFYKVYTVVDEMFLAGEIRETSQTKVLKQLLMLQSLE

SEQ ID NO: 36524 - protein, 955 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 36525 - protein, 977 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTQLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 36526 - protein, 467 aa, Homo sapiens
MGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVLPPTPPRSLWEQQCHCAWRGLSLGVWPSWWLHTWRRPGPLGGAQLTLVLLQSQLDCFPRQDFNLEFRNICICNDFWQKHVSWPDVTVLLSQLLFVKGVCYAPAVAEALDVQPGEERPAGPAGPPGLQGKVWAGGARLRGVLVSFLSEWASPGHGAGLSPSTGPVQSSLEGLWRRDASVWSGSEGAIGRMPCATCGLCLTCHLDSAPRLHV

SEQ ID NO: 36527 - protein, 940 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 36528 - protein, 353 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDREPNLQAQMYRLTLRTSKEAVSQRLCELLSAQF

SEQ ID NO: 36529 - protein, 656 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPEDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVLCL

SEQ ID NO: 36530 - protein, 939 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKNDLASRNPTFMGLALHCIASVGSREMAEAFAGEIPKVLVAGDTMDSVKQSAALCLLRLYRTSPDLVPMGDWTSRVVHLLNDQHLGVVTAATSLITTLAQKNPEEFKTSVSLAVSRLSRIVTSASTDLQDYTYYFVPAPWLSVKLLRLLQCYPPPDPAVRGRLTECLETILNKAQEPPKSKKVQHSNAKNAVLFEAISLIIHHDSEPNLLVRACNQLGQFLQHRETNLRYLALESMCTLASSEFSHEAVKTHIETVINALKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 36531 - protein, 679 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNAIKTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 36532 - protein, 676 aa, Homo sapiens
MPAVSKGDGMRGLAVFISDIRNCKSKEAEIKRINKELANIRSKFKGDKALDGYSKKKYVCKLLFIFLLGHDIDFGHMEAVNLLSSNRYTEKQIGYLFISVLVNSNSELIRLINNTERDVSVRQRAVDLLYAMCDRSNAPQIVAEMLSYLETADYSIREEIVLKVAILAEKYAVDYTWYVDTILNLIRIAGDYVSEEVWYRVIQIVINRDDVQGYAAKTVFEALQAPACHENLVKVGGYILGEFGNLIAGDPRSSPLIQFHLLHSKFHLCSVPTRALLLSTYIKFVNLFPEVKPTIQDVLRSDSQLRNADVELQQRAVEYLRLSTVASTDILATVLEEMPPFPERESSILAKLKKKKGPSTVTDLEDTKRDRSVDVNGGPEPAPASTSAVSTPSPSADLLGLGAAPPAPAGPPPSSGGSGLLVDVFSDSASVVAPLAPGSEDNFARFVCKNNGVLFENQLLQIGLKSEFRQNLGRMFIFYGNKTSTQFLNFTPTLICSDDLQPNLNLQTKPVDPTVEGGAQVQQVVNIECVSDFTEAPVLNIQFRYGGTFQNVSVQLPITLNKFFQPTEMASQDFFQRWKQLSNPQQEVQNIFKAKHPMDTEVTKAKIIGFGSALLEEVDPNPANFVGAGIIHTKTTQIGCLLRLEPNLQAQMYRLTLRTSKEAVSQRLCELLSAQF

SEQ ID NO: 36533 - protein, 937 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 36534 - protein, 951 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 36535 - protein, 951 aa, Homo sapiens; identical to SEQ ID NO: 36534

SEQ ID NO: 36536 - protein, 880 aa, Homo sapiens
MQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 36537 - protein, 688 aa, Homo sapiens
MKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 36538 - protein, 435 aa, Homo sapiens
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 36539 - protein, 433 aa, Homo sapiens
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 36540 - protein, 433 aa, Homo sapiens; identical to SEQ ID NO: 36539

SEQ ID NO: 36541 - protein, 113 aa, Homo sapiens
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLD

SEQ ID NO: 36542 - protein, 420 aa, Homo sapiens
MIGGLFIYNHKGEVLISRVYRDDIGRNAVDAFRVNVIHARQQVRSPVTNIWLAAVTKQNVNAAMVFEFLYKMCDVMAAYFGKISEENIKNNFVLIYELLDEILDFGYPQNSETGALKTFITQQGIKSQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 36543 - protein, 375 aa, Homo sapiens
MIGGLFIYNHKGEVLISRVYRDDIGRNAVAAYFGKISEENIKNNFVLIYELLDEILDFGYPQNSETGALKTFITQQGIKSQHQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 36544 - protein, 142 aa, Homo sapiens
MIRFILIQNRAGKTRLAKWYMQFDDDEKQKLIEEVHAVVTVRDAKHTNFVEFRNFKIIYRRYAGLYFCICVDVNDNNLAYLEAIHNFVEVLNEYFHNVCELDLVFNFYKVYTVVDEMFLAGEIRETSQTKVLKQLLMLQSLE

SEQ ID NO: 36545 - protein, 104 aa, Homo sapiens; identical to SEQ ID NO: 36523

SEQ ID NO: 36546 - protein, 1094 aa, Homo sapiens
MSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNVKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKEKEKKTKQDRTPLTKDVSLLDLDDFNPVSTPVALPTPALSPSLMADLEGLHLSTSSSVISVSTPAFVPTKTHVLLHRMSGKGLAAHYFFPRQPCIFGDKMVSIQITLNNTTDRKIENIHIGEKKLPIGMKMHVFNPIDSLEPEGSITVSMGIDFCDSTQTASFQLCTKDDCFNVNIQPPVGELLLPVAMSEKDFKKEQGVLTGMNETSAVIIAAPQNFTPSVIFQKVVNVANVGAVPSGQDNIHRFAAKTVHSGSLMLVTVELKEGSTAQLIINTEKTVIGSVLLRELKPVLSQG

SEQ ID NO: 36547 - protein, 565 aa, Homo sapiens
MSSNSFPYNEQSGGGEATELGQEATSTISPSGAFGLFSSDLKKNEDLKQMLESNKDSAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNVKSGALSKYAKKIFLAQKPAPLLESPFKDRDHFQLGTLSHTLNIKATGYLELSNWPEVAPDPSVRNVEVIELVVLSE

SEQ ID NO: 36548 - protein, 800 aa, Homo sapiens
MSSNSFPYNEQSGGGEATELGQEATSTISPSGAFGLFSSDLKKNEDLKQMLESNKDSAKLDAMKRIVGMIAKGKNASELFPAVVKNVASKNIEIKKLVYVYLVRYAEEQQDLALLSISTFQRALKDPNQLIRASALRVLSSIRVPIIVPIMMLAIKEASADLSPYVRKNAAHAIQKLYSLDPEQKEMLIEVIEKLLKDKSTLVAGSVVMAFEEVCPDRIDLIHKNYRKLCNLLVDVEEWGQVVIIHMLTRYARTQFVSPWKEGDELEDNGKNFYESDDDQKEKTDKKKKPYTMDPDHRLLIRNTKPLLQSRNAAVVMAVAQLYWHISPKSEAGIISKSLVRLLRSNREVQYIVLQNIATMSIQRKGMFEPYLKSFYVRSTDPTMIKTLKLEILTNLANEANISTLLREFQTYVKSQDKQFAAATIQTIGRCATNILEVTDTCLNGLVCLLSNRDEIVVAESVVVIKKLLQMQPAQHGEIIKHMAKLLDSITVPVARASILWLIGENCERVPKIAPDVLRKMAKSFTSEDDLVKLQILNLGAKLYLTNSKQTKLLTQYILNLGKYDQNYDIRDRTRFIRQLIVPNVKSGALSKYAKKIFLAQKPAPLLESPFKDRDHFQLGTLSHTLNIKATGYLELSNWPEVAPDPSVRNVEVIELAKEWTPAGKAKQENSAKKFYSESEEEEDSSDSSSDSESESGSESGEQGESGEEGDSNEDSSEDSSSEQDSESGRESGLENKRTAKRNSKAKGKSDSEDGEKENEKSKTSDSSNDESSSIEDSSSDSESESEPESESESRRVTKE

SEQ ID NO: 36549 - protein, 193 aa, Homo sapiens
MIKAILIFNNHGKPRLSKFYQPYSEDTQQQIIRETFHLVSKRDENVCNFLEGGLLIGGSDNKLIYRHYATLYFVFCVDSSESELGILDLIQVFVETLDKCFENVCELDLIFHVDKVHNILAEMVMGGMVLETNMNEIVTQIDAQNKLEKSEAGLAGAPARAVSAVKNMNLPEIPRNINIGDISIKVPNLPSFK

SEQ ID NO: 36550 - protein, 149 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDVSFFNTVFHSTWQMHSGPYQTRSCSVTQAGVQRCDHGSLHPGSPGLK

SEQ ID NO: 36551 - protein, 135 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVEPIDELPKICSALEPQQTCFSPDSSSFKGAASTTPIY

SEQ ID NO: 36552 - protein, 739 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGPLIPEENKERVQELPDSGALMLVPNRQLTADYFEKTWLSLKVAHQQVLPWRGEFHPDTLQMALQVVNIQTIAMSRAGSRPWKAYLSAQDDTGCLFLTELLLEPGNSEMQISVKQNEARTETLNSFISVLETVIGTIEEIKS

SEQ ID NO: 36553 - protein, 296 aa, Homo sapiens
MPYLGSEDVVKELKKALCNPHIQADRLRYRNVIQRVIRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAI

SEQ ID NO: 36554 - protein, 302 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGRCLLLFLLENLDQPARKLWLEEP

SEQ ID NO: 36555 - protein, 571 aa, Homo sapiens
MPYLGSEDVVKELKKALCNPHIQADRLRYRNVIQRVIRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDENVQQVLEELRGYCTDVSADFAQAAIFAIGGIARTYTDQCVQILTELLGLRQEHITTVVVQTFRDLVWLCPQCTEAVCQALPGCEENIQDSEGKQALIWLLGVHGERIPNAPYVLEDFVENVKSETFPAVKMELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGPLIPEENKERVQELPDSGALMLVPNRQLTADYFEKTWLSLKVAHQQVLPWRGEFHPDTLQMALQVVNIQTIAMSRAGSRPWKAYLSAQDDTGCLFLTELLLEPGNSEMQISVKQNEARTETLNSFISVLETVIGTIEEIKS

SEQ ID NO: 36556 - protein, 739 aa, Homo sapiens; identical to SEQ ID NO: 36552

SEQ ID NO: 36557 - protein, 262 aa, Homo sapiens
MPYLGSEDVVKELKKALCNPHIQADRLRYRNVIQRVIRYMTQGLDMSGVFMEMVKASATVDIVQKKLVYLYMCTYAPLKPDLALLAINTLCKDCSDPNPMVRGLALRSMCSLRMPGVQEYIQQPILNGLRDKASYVRRVAVLGCAKMHNLHGDSEVDGALVNELYSLLRDQDPIVVVNCLRSLEEILKQEGGVVINKPIAHHLLNRMSKLDQWGQAEVLNFLLRYQPRSEEELFDILNLLDSFLKSSSPGVVMGATKLFLIL

SEQ ID NO: 36558 - protein, 175 aa, Homo sapiens
MPYLGSEDVVKELKKALCNPHIQADRLRYRNVIQRVIRMSKLDQWGQAEVLNFLLRYQPRSEEELFDILNLLDSFLKSSSPGVVMGATKLFLILAKMFPHVQTDVLVRVKGPLLAACSSESRELCFVALCHVRQILHSLPGHFSSHYKKFFCSYSEPHYIKLQKVEVLCELVNDE

SEQ ID NO: 36559 - protein, 1137 aa, Homo sapiens
MSDIVEKTLTALPGLFLQNQPGGGPAAAKASFSSRLGSLVRGITALTSKHEEEKLIQQELSSLKATVSAPTTTLKMMKECMVRLIYCEMLGYDASFGYIHAIKLAQQGNLLEKRVGYLAVSLFLHESHELLLLLVNTVVKDLQSTNLVEVCMALTVVSQIFPCEMIPAVLPLIEDKLQHSKEIVRRKAVLALYKFHLIAPNQVQHIHIKFRKALCDRDVGVMAASLHIYLRMIKENSSGYKDLTGSFVTILKQVVGGKLPVEFNYHSVPAPWLQIQLLRILGLLGKDDQRTSELMYDVLDESLRRAELNHNVTYAILFECVHTVYSIYPKSELLEKAAKCIGKFVLSPKINLKYLGLKALTYVIQQDPTLALQHQMTIIECLDHPDPIIKRETLELLYRITNAQNITVIVQKMLEYLHQSKEEYVIVNLVGKIAELAEKYAPDNAWFIQTMNAVFSVGGDVMHPDIPNNFLRLLAEGFDDETEDQQLRLYAVQSYLTLLDMENVFYPQRFLQVMSWVLGEYSYLLDKETPEEVIAKLYKLLMNDSVSSETKAWLIAAVTKLTSQAHSSNTVERLIHEFTISLDTCMRQHAFELKHLHENVELMKSLLPVDRSCEDLVVDASLSFLDGFVAEGLSQGAAPYKPPHQRQEEKLSQEKVLNFEPYGLSFSSSGFTGRQSPAGISLGSDVSGNSAETGLKETNSLKLEGIKKLWGKEGYLPKKESKTGDESGALPVPQESIMENVDQAITKKDQSQVLTQSKEEKEKQLLASSLFVGLGSESTINLLGKADTVSHKFRRKSKVKEAKSGETTSTHNMTCSSFSSLSNVAYEDDYYSNTLHDTGDKELKKFSLTSELLDSESLTELPLVEKFSYCSLSTPSLFANNNMEIFHPPQSTAASVAKESSLASSFLEETTEYIHSNAMEVCNNETISVSSYKIWKDDCLLMVWSVTNKSGLELKSADLEIFPAENFKVTEQPGCCLPVMEAESTKSFQYSVQIEKPFTEGNLTGFISYHMMDTHSAQLEFSVNLSLLDFIRPLKISSDDFGKLWLSFANDVKQNVKMSESQAALPSALKTLQQKLRLHIIEIIGNEGLLACQLLPSIPCLLHCRVHADVLALWFRSSCSTLPDYLLYQCQKVMEGS

SEQ ID NO: 36560 - protein, 453 aa, Homo sapiens
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 36561 - protein, 453 aa, Homo sapiens; identical to SEQ ID NO: 36560

SEQ ID NO: 36562 - protein, 159 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDVSFFNTVFHSTWQMHSGPYQEPIDELPKICSALEPQQTCFSPDSSSFKGAASTTPIY

SEQ ID NO: 36563 - protein, 144 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVVKGHIMFNLDKVHIILDEMVLNGCIVETNRARILAPLLILDKMSES

SEQ ID NO: 36564 - protein, 144 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDIMFNLDKVHIILDEMVLNGCIVETNRARILAPLLILDKMSES

SEQ ID NO: 36565 - protein, 8 aa, Homo sapiens
MIKFFLMV

SEQ ID NO: 36566 - protein, 98 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRV

SEQ ID NO: 36567 - protein, 133 aa, Homo sapiens
MIKFFLMVNKQGQTRLSKYYEHVDINKRTLLETEVIKSCLSRSNEQCSFIEYKDFKLIYRQYAALFIVVGVNDTENEMAIYEFIHNFVEVLDEYFSRVSELDIMFNLDKVHIILDEMVLNGCIVETNRARILA

SEQ ID NO: 36568 - protein, 1536 aa, Homo sapiens
MGVVNFVFRASEDLQVLENYSDAPMTPKQILQVIEAEGLKEMSGTSPLACLNAMLHSNSRGGEGLFYKLPGRISLFTLKKDALQWSRHPATVEGEEPEDTADVESCGSNEASTVSGENDVSLDETSSNASCSTESQSRPLSNPRDSYRASSQANKQKKKTGVMLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPILSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 36569 - protein, 1541 aa, Homo sapiens
MKDKQKKKKERTWAEAARLVLENYSDAPMTPKQILQVIEAEGLKEMRSGTSPLACLNAMLHSNSRGGEGLFYKLPGRISLFTLKKDALQWSRHPATVEGEEPEDTADVESCGSNEASTVSGENDVSLDETSSNASCSTESQSRPLSNPRDSYRASSQANKQKKKTGVMLPRVVLTPLKVNGAHVESASGFSGCHADGESGSPSSSSSGSLALGSAAIRGQAEVTQDPAPLLRGFRKPATGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREAATTAIGGGGGPGGGGGGATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPILSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 36570 - protein, 1541 aa, Homo sapiens; identical to SEQ ID NO: 36569

SEQ ID NO: 36571 - protein, 1462 aa, Homo sapiens
MLSFPNLNQVLENYSDAPMTPKQILQVIEAEGLKEMSSGTSPLACLNAMLHSNSRGGEGLFYKLPGRISLFTLKKDALQWSRHPATVEGEEPEDTADVESCGSNEASTVSGENDVSLDETSSNASCSTESQSRPLSNPRDSYRASSQANKQKKKTGVMLPRVVLTPLKVNGAHVESASGQMKRNRGEEIDFETPGSILVNTNLRALINSRTFHALPSHFQQQLLFLLPEVDRQVGTDGLLRLSSSALNNEFFTHAAQSWRERLADGEFTHEMQVRIRQEMEKEKKVEQWKEKFFEDYYGQKLGLTKEESLQQNVGQEEAEIKSGLCVPGESVRIQRGPATRQRDGHFKKRSRPDLRTRARRNLYKKQESEQAGVAKDAKSVASDVPLYKDGEAKTDPAGLSSPHLPGTSSAAPDLEGPEFPVESVASRIQAEPDNLARASASPDRIPSLPQETVDQEPKDQKRKSFEQAASASFPEKKPRLEDRQSFRNTIESVHTEKPQPTKEEPKVPPIRIQLSRIKPPWVVKGQPTYQICPRIIPTTESSCRGWTGARTLADIKARALQVRGARGHHCHREATDEGGGRGSSSGDGGEACGHPEPRGGPSTPGKCTSDLQRTQLLPPYPLNGEHTQAGTAMSRARREDLPSLRKEESCLLQRATVGLTDGLGDASQLPVAPTGDQPCQALPLLSSQTSVAERLVEQPQLHPDVRTECESGTTSWESDDEEQGPTVPADNGPILSLVGDDTLEKGTGQALDSHPTMKDPVNVTPSSTPESSPTDCLQNRAFDDELGLGGSCPPMRESDTRQENLKTKALVSNSSLHWIPIPSNDEVVKQPKPESREHIPSVEPQVGEEWEKAAPTPPALPGDLTAEEGLDPLDSLTSLWTVPSRGGSDSNGSYCQQVDIEKLKINGDSEALSPHGESTDTASDFEGHLTEDSSEADTREAAVTKGSSVDKDEKPNWNQSAPLSKVNGDMRLVTRTDGMVAPQSWVSRVCAVRQKIPDSLLLASTEYQPRAVCLSMPGSSVEATNPLVMQLLQGSLPLEKVLPPAHDDSMSESPQVPLTKDQSHGSLRMGSLHGLGKNSGMVDGSSPSSLRALKEPLLPDSCETGTGLARIEATQAPGAPQKNCKAVPSFDSLHPVTNPITSSRKLEEMDSKEQFSSFSCEDQKEVRAMSQDSNSNAAPGKSPGDLTTSRTPRFSSPNVISFGPEQTGRALGDQSNVTGQGKKLFGSGNVAATLQRPRPADPMPLPAEIPPVFPSGKLGPSTNSMSGGVQTPREDWAPKPHAFVGSVKNEKTFVGGPLKANAENRKATGHSPLELVGHLEGMPFVMDLPFWKLPREPGKGLSEPLEPSSLPSQLSIKQAFYGKLSKLQLSSTSFNYSSSSPTFPKGLAGSVVQLSHKANFGASHSASLSLQMFTDSSTVESISLQCACSLKAMIMCQGCGAFCHDDCIGPSKLCVLCLVVR

SEQ ID NO: 36572 - protein, 1541 aa, Homo sapiens; identical to SEQ ID NO: 36569

SEQ ID NO: 36573 - protein, 74 aa, Homo sapiens
  MOD_RES (1)..(1): Any amino acid
XWAEAARLVLENYSDAPMTPKQILQVIEAEGLKEMRSGTSPLACLNAMLHSNSRGGEGLFYKLPGRISLFTLKV

SEQ ID NO: 36574 - protein, 85 aa, Homo sapiens
MKDKQKKKKERTWAEAARLVLENYSDAPMTPKQILQVIEAEGLKEMRSGTSPLACLNAMLHSNSRGGEGLFYKLPGRISLFTLKV

SEQ ID NO: 36575 - protein, 84 aa, Homo sapiens
MKDKQKKKKERTWAEAARLVLENYSDAPMTPKQILQVIEAEGLKEMSGTSPLACLNAMLHSNSRGGEGLFYKLPGRISLFTLKR

SEQ ID NO: 36576 - protein, 918 aa, Homo sapiens
MKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 36577 - protein, 1407 aa, Homo sapiens [sequence omitted]

SEQ ID NO: 36578 - protein, 918 aa, Homo sapiens; identical to SEQ ID NO: 36576

SEQ ID NO: 36579 - protein, 1435 aa, Homo sapiens
MREKGRRKKGRTWAEAAKTVLEKYPNTPMSHKEILQVIQREGLKEIRSGTSPLACLNAMLHTNSRGEEGIFYKVPGRMGVYTLKKDVPDGVKELSEGSEESSDGQSDSQSSENSSSSSDGGSNKEGKKSRWKRKVSSSSPQSGCPSPTIPAGKVISPSQKHSKKALKQALKQQQQKKQQQQCRPSISISSNQHLSLKTVKAASDSVPAKPATWEGKQSDGQTGSPQNSNSSFSSSVKVENTLLGLGKKSFQRSERLHTRQMKRTKCADIDVETPDSILVNTNLRALINKHTFSVLPGDCQQRLLLLLPEVDRQVGPDGLMKLNGSALNNEFFTSAAQGWKERLSEGEFTPEMQVRIRQEIEKEKKVEPWKEQFFESYYGQSSGLSLEDSKKLTASPSDPKVKKTPAEQPKSMPVSEASLIRIVPVVSQSECKEEALQMSSPGRKEECESQGEVQPNFSTSSEPLLSSALNTHELSSILPIKCPKDEDLLEQKPVTSAEQESEKNHLTTASNYNKSESQESLVTSPSKPKSPGVEKPIVKPTAGAGPQETNMKEPLATLVDQSPESLKRKSSLTQEEAPVSWEKRPRVTENRQHQQPFQVSPQPFLNRGDRIQVRKVPPLKIPVSRISPMPFHPSQVSPRARFPVSITSPNRTGARTLADIKAKAQLVKAQRAAAAAAAAAAAAASVGGTIPGPGPGGGQGPGEGGEGQTARGGSPGSDRVSETGKGPTLELAGTGSRGGTRELLPCGPETQPQSETKTTPSQAQPHSVSGAQLQQTPPVPPTPAVSGACTSVPSPAHIEKLDNEKLNPTRATATVASVSHPQGPSSCRQEKAPSPTGPALISGASPVHCAADGTVELKAGPSKNIPNPSASSKTDASVPVAVTPSPLTSLLTTATLEKLPVPQVSATTAPAGSAPPSSTLPAASSLKTPGTSLNMNGPTLRPTSSIPANNPLVTQLLQGKDVPMEQILPKPLTKVEMKTVPLTAKEERGMGALIATNTTENSTREEVNERQSHPATQQQLGKTLQSKQLPQVPRPLQLFSAKELRDSSIDTHQYHEGLSKATQDQILQTLIQRVRRQNLLSVVPPSQFNFAHSGFQLEDISTSQRFMLGFAGRRTSKPAMAGHYLLNISTYGRGSESFRRTHSVNPEDRFCLSSPTEALKMGYTDCKNATGESSSSKEDDTDEESTGDEQESVTVKEEPQVSQSAGKGDTSSGPHSRETLSTSDCLASKNVKAEIPLNEQTTLSKENYLFTRGQTFDEKTLARDLIQAAQKQMAHAVRGKAIRSSPELFSSTVLPLPADSPTHQPLLLPPLQTPKLYGSPTQIGPSYRGMINVSTSSDMDHNSAVPGSQVSSNVGDVMSFSVTVTTIPASQAMNPSSHGQTIPVQAFSEENSIEGTPSKCYCRLKAMIMCKGCGAFCHDDCIGPSKLCVSCLVVR

SEQ ID NO: 36580 - protein, 2248 aa, Homo sapiens
MKDKRKKKDRTWAEAARLALEKHPNSPMTAKQILEVIQKEGLKETSGTSPLACLNAMLHTNTRIGDGTFFKIPGKSGLYALKKEESSCPADGTLDLVCESELDGTDMAEANAHGEENGVCSKQVTDEASSTRDSSLTNTAVQSKLVSSFQQHTKKALKQALRQQQKRRNGVSMMVNKTVPRVVLTPLKVSDEQSDSPSGSESKNGEADSSDKEMKHGQKSPTGKQTSQHLKRLKKSGLGHLKWTKAEDIDIETPGSILVNTNLRALINKHTFASLPQHFQQYLLLLLPEVDRQMGSDGILRLSTSALNNEFFAYAAQGWKQRLAEGEFTPEMQLRIRQEIEKEKKTEPWKEKFFERFYGEKLGMSREESVKLTTGPNNAGAQSSSSCGTSGLPVSAQTALAEQQPKSMKSPASPEPGFCATLCPMVEIPPKDIMAELESEDILIPEESVIQEEIAEEVETSICECQDENHKTIPEFSEEAESLTNSHEEPQIAPPEDNLESCVMMNDVLETLPHIEVKIEGKSESPQEEMTVVIDQLEVCDSLIPSTSSMTHVSDTEHKESETAVETSTPKIKTGSSSLEGQFPNEGIAIDMELQSDPEEQLSENACISETSFSSESPEGACTSLPSPGGETQSTSEESCTPASLETTFCSEVSSTENTDKYNQRNSTDENFHASLMSEISPISTSPEISEASLMSNLPLTSEASPVSNLPLTSETSPMSDLPLTSETSSVSSMLLTSETTFVSSLPLPSETSPISNSSINERMAHQQRKSPSVSEEPLSPQKDESSATAKPLGENLTSQQKNLSNTPEPIIMSSSSIAPEAFPSEDLHNKTLSQQTCKSHVDTEKPYPASIPELASTEMIKVKNHSVLQRTEKKVLPSPLELSVFSEGTDNKGNELPSAKLQDKQYISSVDKAPFSEGSRNKTHKQGSTQSRLETSHTSKSSEPSKSPDGIRNESRDSEISKRKTAEQHSFGICKEKRARIEDDQSTRNISSSSPPEKEQPPREEPRVPPLKIQLSKIGPPFIIKSQPVSKPESRASTSTSVSGGRNTGARTLADIKARAQQARAQREAAAAAAVAAAASIVSGAMGSPGEGGKTRTLAHIKEQTKAKLFAKHQARAHLFQTSKETRLPPPLSSKEGPPNLEVSSTPETKMEGSTGVIIVNPNCRSPSNKSAHLRETTTVLQQSLNPSKLPETATDLSVHSSDENIPVSHLSEKIVSSTSSENSSVPMLFNKNSVPVSVCSTAISGAIKEHPFVSSVDKSSVLMSVDSANTTISACNISMLKTIQGTDTPCIAIIPKCIESTPISATTEGSSISSSMDDKQLLISSSSASNLVSTQYTSVPTPSIGNNLPNLSTSSVLIPPMGINNRFPSEKIAIPGSEEQATVSMGTTVRAALSCSDSVAVTDSLVAHPTVAMFTGNMLTINSYDSPPKLSAESLDKNSGPRNRADNSGKPQQPPGGFAPAAINRSIPCKVIVDHSTTLTSSLSLTVSVESSEASLDLQGRPVRTEASVQPVACPQVSVISRPEPVANEGIDHSSTFIAASAAKQDSKTLPATCTSLRELPLVPDKLNEPTAPSHNFAEQARGPAPFKSEADTTCSNQYNPSNRICWNDDGMRSTGQPLVTHSGSSKQKEYLEQSCPKAIKTEHANYLNVSELHPRNLVTNVALPVKSELHEADKGFRMDTEDFPGPELPPPAAEGASSVQQTQNMKASTSSPMEEAISLATDALKRVPGAGSSGCRLSSVEANNPLVTQLLQGNLPLEKVLPQPRLGAKLEINRLPLPLQTTSVGKTAPERNVEIPPSSPNPDGKGYLAGTLAPLQMRKRENHPKKRVARTVGEHTQVKCEPGKLLVEPDVKGVPCVISSGISQLGHSQPFKQEWLNKHSMQNRIVHSPEVKQQKRLLPSCSFQQNLFHVDKNGGFHTDAGTSHRQQFYQMPVAARGPIPTAALLQASSKTPVGCNAFAFNRHLEQKGLGEVSLSSAPHQLRLANMLSPNMPMKEGDEVGGTAHTMPNKALVHPPPPPPPPPPPPLALPPPPPPPPPLPPPLPNAEVPSDQKQPPVTMETTKRLSWPQSTGICSNIKSEPLSFEEGLSSSCELGMKQVSYDQNEMKEQLKAFALKSADFSSYLLSEPQKPFTQLAAQKMQVQQQQQLCGNYPTIHFGSTSFKRAASAIEKSIGILGSGSNPATGLSGQNAQMPVQNFADSSNADELELKCSCRLKAMIVCKGCGAFCHDDCIGPSKLCVACLVVR

SEQ ID NO: 36581 - protein, 768 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 36582 - protein, 662 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQDAPLSDCTETIEGLELTEQTFSPAKSLSFRKGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 36583 - protein, 662 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEGDGCAREYLLP

SEQ ID NO: 36584 - protein, 400 aa, Homo sapiens [sequence omitted]

SEQ ID NO: 36585 - protein, 662 aa, Homo sapiens; identical to SEQ ID NO: 36583

SEQ ID NO: 36586 - protein, 737 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGSDGSPGKSPSKKKKKFRTPSFLKKSKKKSDS

SEQ ID NO: 36587 - protein, 737 aa, Homo sapiens; identical to SEQ ID NO: 36586

SEQ ID NO: 36588 - protein, 137 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIA

SEQ ID NO: 36589 - protein, 632 aa, Homo sapiens
MNGDSRAAVVTSPPPTTAPHKERYFDRVDENNPEYLRERNMAPDLRQDFNMMEQKKRVSMILQSPAFCEELESMIQEQFKKGKNPTGLLALQQIADFMTTNVPNVYPAAPQGGMAALNMSLGMVTPVNDLRGSDSIAYDKGEKLLRCKLAAFYRLADLFGWSQLIYNHITTRVNSEQEHFLIVPFGLLYSEVTASSLVKINLQGDIVDRGSTNLGVNQAGFTLHSAIYAARPDVKCVVHIHTPAGAAVSAMKCGLLPISPEALSLGEVAYHDYHGILVDEEEKVLIQKNLGPKSKVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEAGDGCAREYLLP

SEQ ID NO: 36590 - protein, 444 aa, Homo sapiens
  MOD_RES (1)..(1): Any amino acid
XVLILRNHGLVSVGESVEEAFYYIHNLVVACEIQVRTLASAGGPDNLVLLNPEKYKAKSRSPGSPVGEGTGSPPKWQIGEQEFEALMRMLDNLGYRTGYPYRYPALREKSKKYSDVEVPASVTGYSFASDGDSGTCSPLRHSFQKQQREKTRWLNSGRGDEASEEGQNGSSPKSKTKVWTNITHDHVKPLLQSLSSGVCVPSCITNCLWTKEDGHRTSTSAVPNLFVPLNTNPKEVQEMRNKIREQNLQDIKTAGPQSQVLCGVVMDRSLVQGELVTASKAIIEKEYQPHVIVSTTGPNPFTTLTDRELEEYRREVERKQKGSEENLDEAREQKEKSPPDQPAVPHPPPSTPIKLEEDLVPEPTTGDDSDAATFKPTLPDLSPDEPSEALGFPMLEKEEEAHRPPSPTEAPTEASPEPAPDPAPVAEEAAPSAVEEGAAADPGS

SEQ ID NO: 36591 - protein, 726 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 36592 - protein, 98 aa, Homo sapiens
MSEETVPEAASPPPPQGQPYFDRFSEDDPEYMRLRNRAADLRQDFNLMEQKKRVTMILQSPSFREELEGLIQEQMKKEYKKEVERKKLELDAPGWFSS

SEQ ID NO: 36593 - protein, 587 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDAPGWFSS

SEQ ID NO: 36594 - protein, 726 aa, Homo sapiens; identical to SEQ ID NO: 36591

SEQ ID NO: 36595 - protein, 726 aa, Homo sapiens; identical to SEQ ID NO: 36591

SEQ ID NO: 36596 - protein, 559 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 36597 - protein, 226 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCII

SEQ ID NO: 36598 - protein, 143 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRL

SEQ ID NO: 36599 - protein, 575 aa, Homo sapiens
MPRRRVPGANCKPTGKMSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 36600 - protein, 17 aa, Homo sapiens
MSEETVPEAASPPPPQG

SEQ ID NO: 36601 - protein, 281 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLVSEVLEMRNKIREQNRQDVKSAGPQSQLLASVIAEKSRSPSTESQLMSKGDEDTKDDSEETVPNPFSQLTDQELEEYKKEVERKKLELDAPGWFSS

SEQ ID NO: 36602 - protein, 643 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDETGQEREPGSGPAVCEFFSVALHIWSNILERKKLPQKSLAHLQSLHLLLQCRAQRRRQRQRAL

SEQ ID NO: 36603 - protein, 674 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 36604 - protein, 706 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEDAEQELLSDDASSVSQIQSQTQSPQNVPEKLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 36605 - protein, 674 aa, Homo sapiens; identical to SEQ ID NO: 36603

SEQ ID NO: 36606 - protein, 180 aa, Homo sapiens
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGGTMNAACELLGRLQAEVLECVSLVELTSLKGREKLAPVPFFSLLQYE

SEQ ID NO: 36607 - protein, 134 aa, Homo sapiens
MADSELQLVEQRIRSFPDFPTPGVVFRDISPVLKDPASFRAAIGLLARHLKATHGGRIDYIAGLDSRGFLFGPSLAQELGLGCVLIRKRGKLPGPTLWASYSLEYGKAELEIQKDALEPGQRVVVVDDLLATGV

SEQ ID NO: 36608 - protein, 2303 aa, Homo sapiens
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETQFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 36609 - protein, 2029 aa, Homo sapiens
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 36610 - protein, 2303 aa, Homo sapiens; identical to SEQ ID NO: 36608

SEQ ID NO: 36611 - protein, 514 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 36612 - protein, 565 aa, Homo sapiens
MKRRCSCGGGGGHCSSERRRTRPEAEGRARAQLPGHQIGARRAGGPRAGLEMSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 36613 - protein, 326 aa, Homo sapiens
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 36614 - protein, 326 aa, Homo sapiens; identical to SEQ ID NO: 36613

SEQ ID NO: 36615 - protein, 125 aa, Homo sapiens
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRRISQCMASTKS

SEQ ID NO: 36616 - protein, 326 aa, Homo sapiens; identical to SEQ ID NO: 36613

SEQ ID NO: 36617 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 36618 - protein, 412 aa, Homo sapiens; identical to SEQ ID NO: 36617

SEQ ID NO: 36619 - protein, 88 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLT

SEQ ID NO: 36620 - protein, 64 aa, Homo sapiens
MPIMGSSVYITVELAIAVLAILGNVLVCWAVWLNSNLQNVTNYFVVSLAAADIAVGVLAIPFAI

SEQ ID NO: 36621 - protein, 76 aa, Homo sapiens
MPIMGSSVYITVELAIAVLAILGNVLVCWAVWLNSNLQNVTNYFVVSLAAADIAVGVLAIPFAITISTGFCAACHG

SEQ ID NO: 36622 - protein, 365 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGL

SEQ ID NO: 36623 - protein, 412 aa, Homo sapiens; identical to SEQ ID NO: 36617

SEQ ID NO: 36624 - protein, 332 aa, Homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 36625 - protein, 318 aa, Homo sapiens
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 36626 - protein, 178 aa, Homo sapiens
MEGSPAGPIEQKEARWESSWEEQPDWTLGCLSPESHTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 36627 - protein, 347 aa, Homo sapiens
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 36628 - protein, 266 aa, Homo sapiens
MEGSPAGPIEQKEARWESSWEEQPDWTLGCLSPESQFRIPGLPGCILSFQLKVCFLPVMWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 36629 - protein, 207 aa, Homo sapiens
  MOD_RES (1)..(1): Any amino acid
XPQALQGPPSSNDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 36630 - protein, 115 aa, Homo sapiens
  MOD_RES (1)..(1): Any amino acid
XPSSHVALHSTLLGSHFSTNHVALRDTGNQLIVTMSCLTKEDTGWYWCGIQRDFARDDMDFTELIVTDDKGTLANDFWSGKDLSGNKTRSCKAPKVVRKADRSRTSILIICILIT

SEQ ID NO: 36631 - protein, 172 aa, Homo sapiens
GPIEQKEARWESSWEEQPDWTLGCLSPESHTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 36632 - protein, 363 aa, Homo sapiens
MAQTPAFDKPKVELHVHLDGSIKPETILYYGRRRGIALPANTAEGLLNVIGMDKPLTLPDFLAKFDYYMPAIAGCREAIKRIAYEFVEMKAKEGVVYVEVRYSPHLLANSKVEPIPWNQAEGDLTPDEVVALVGQGLQEGERDFGVKARSILCCMRHQPNWSPKVVELCKKYQQQTVVAIDLAGDETIPGSSLLPGHVQAYQEAVKSGIHRTVHAGEVGSAEVVKEAVDILKTERLGHGYHTLEDQALYNRLRQENMHFEICPWSSYLTGAWKPDTEHAVIRLKNDQANYSLNTDDPLIFKSTLDTDYQMTKRDMGFTEEEFKRLNINAAKSSFLPEDEKRELLDLLYKAYGMPPSASAGQNL

SEQ ID NO: 36633 - protein, 576 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLRYFYRQLLLFYSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 36634 - protein, 565 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 36635 - protein, 241 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIER

SEQ ID NO: 36636 - protein, 156 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAK

SEQ ID NO: 36637 - protein, 558 aa, Homo sapiens
MLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLRYFYRQLLLFYSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 36638 - protein, 1269 aa, Homo sapiens
MMSPICDQTIDSRLKVEKATWWGRVGGGSRPHWQSPGVRPCPEEVQDPGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 36639 - protein, 52 aa, Homo sapiens
MANEHTLIHPASIEDPLEARPMSDEDPEDEDALPARWKKEMGRKRKRTIATL

SEQ ID NO: 36640 - protein, 701 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 36641 - protein, 741 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 36642 - protein, 714 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKVH

SEQ ID NO: 36643 - protein, 12 aa, Homo sapiens
MDIEDEENMSFS

SEQ ID NO: 36644 - protein, 141 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRS

SEQ ID NO: 36645 - protein, 741 aa, Homo sapiens; identical to SEQ ID NO: 36641

SEQ ID NO: 36646 - protein, 741 aa, Homo sapiens; identical to SEQ ID NO: 36641

SEQ ID NO: 36647 - protein, 698 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWACARQGSLPLTTLQDYQAQRVP

SEQ ID NO: 36648 - protein, 141 aa, Homo sapiens
MSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 36649 - protein, 248 aa, Homo sapiens
MGLWSPVPGNSVPRAPVMAGLGLGHSQGAPQGPHDGKTDRSSGPGRRRTERTRLPGLLGGAPLTAGSPHRWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 36650 - protein, 739 aa, Homo sapiens
MASVLGSGRGSGGLSSQLKCKSKRRRRRRSKRKDKVSILSTFLAPFKHLSPGITNTEDDDTLSTSSAEVKENRNVGNLAARPPPSGDRARGGAPGAKRKRPLEEGNGGHLCKLQLVWKKLSWSVAPKNALVQLHELRPGLQYRTVSQTGPVHAPVFAVAVEVNGLTFEGTGPTKKKAKMRAAELALRSFVQFPNACQAHLAMGGGPGPGTDFTSDQADFPDTLFQEFEPPAPRPGLAGGRPGDAALLSAAYGRRRLLCRALDLVGPTPATPAAPGERNPVVLLNRLRAGLRYVCLAEPAERRARSFVMAVSVDGRTFEGSGRSKKLARGQAAQAALQELFDIQMPGHAPGRARRTPMPQEFADSISQLVTQKFREVTTDLTPMHARHKALAGIVMTKGLDARQAQVVALSSGTKCISGEHLSDQGLVVNDCHAEVVARRAFLHFLYTQLELHLSKRREDSERSIFVRLKEGGYRLRENILFHLYVSTSPCGDARLHSPYEITTDLHSSKHLVRKFRGHLRTKIESGEGTVPVRGPSAVQTWDGVLLGEQLITMSCTDKIARWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 36651 - protein, 502 aa, Homo sapiens
MWTADEIAQLCYEHYGIRLPKKGKPEPNHEWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWAHNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVQKLDTYQEYKEAASSYQEAWSTLRKQVFGSWIRNPPDYHQFK

SEQ ID NO: 36652 - protein, 473 aa, Homo sapiens
MWTLLAAVVKIQSPADKACDTPDKPVQVTKEVVSMGTGTKCIGQSKMRKNGDILNDSHAEVIARRSFQRYLLHQLQLAATLKEDSIFVPGTQKGVWKLRRDLIFVFFSSHTPCGDASIIPMLEFEDQPCCPVFRNWAHNSSVEASSNLEAPGNERKCEDPDSPVTKKMRLEPGTAAREVTNGAAHHQSFGKQKSGPISPGIHSCDLTVEGLATVTRIAPGSAKVIDVYRTGAKCVPGEAGDSGKPGAAFHQVGLLRVKPGRGDRTRSMSCSDKMARWNVLGCQGALLMHLLEEPIYLSAVVIGKCPYSQEAMQRALIGRCQNVSALPKGFGVQELKILQSDLLFEQSRSAVQAKRADSPGRLVPCGAAISWSAVPEQPLDVTANGFPQGTTKKTIGSLQARSQISKVELFRSFQKLLSRIARDKWPHSLRVQKLDTYQEYKEAASSYQEAWSTLRKQVFGSWIRNPPDYHQFK

SEQ ID NO: 36653 - protein, 362 aa, Homo sapiens
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 36654 - protein, 345 aa, Homo sapiens
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 36655 - protein, 305 aa, Homo sapiens
MAAAEEEPKPKKLKVEAPQALRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 36656 - protein, 327 aa, Homo sapiens
MTSVRENILFGMGNPLLDISAVVDKDFLDKFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFISQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFH

SEQ ID NO: 36657 - protein, 747 aa, Homo sapiens
MPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 36658 - protein, 780 aa, Homo sapiens
MNVRIFYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 36659 - protein, 776 aa, Homo sapiens
MNVRIFYSVSQSPHSLLSLLFYCAILESRISATMPLFKLPEIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 36660 - protein, 879 aa, Homo sapiens
MRNRGQGLFRLRSRCFLHQSLPLGAGRRKGLDVAEPGPSRCRSDSPAVAAVVPAMASYPSGSGKPKAKYPFKKRASLQASTAAPEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 36661 - protein, 798 aa, Homo sapiens
MASEARGGLGAPPLQSARSLPGPAPCLKHFPLDLRTSMDGKCKEIAEELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 36662 - protein, 804 aa, Homo sapiens
MWQSQAPAGAAQTPPLSPPWSQPWHPIHLALASPRPNIPLRSGPACRPPLQLQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 36663 - protein, 760 aa, Homo sapiens
MLTFLPSPQELFTRSLAESELRSAPYEFPEESPIEQLEERRQRLERQISQDVKLEPDILLRAKQDFLKTDSDSDLQLYKEQGEGQGDRSLRERDVLEREFQRVTISGEEKCGVPFTDLLDAAKSVVRALFIREKYMALSLQSFCPTTRRYLQQLAEKPLETRTYEQGPDTPVSADAPVHPPALEQHPYEHCEPSTMPGDLGLGLRMVRGVVHVYTRREPDEHCSEVELPYPDLQEFVADVNVLMALIINGPIKSFCYRRLQYLSSKFQMHVLLNEMKELAAQKKVPHRDFYNIRKVDTHIHASSCMNQKHLLRFIKRAMKRHLEEIVHVEQGREQTLREVFESMNLTAYDLSVDTLDVHADRNTFHRFDKFNAKYNPIGESVLREIFIKTDNRVSGKYFAHIIKEVMSDLEESKYQNAELRLSIYGRSRDEWDKLARWAVMHRVHSPNVRWLVQVPRLFDVYRTKGQLANFQEMLENIFLPLFEATVHPASHPELHLFLEHVDGFDSVDDESKPENHVFNLESPLPEAWVEEDNPPYAYYLYYTFANMAMLNHLRRQRGFHTFVLRPHCGEAGPIHHLVSAFMLAENISHGLLLRKAPVLQYLYYLAQIGIAMSPLSNNSLFLSYHRNPLPEYLSRGLMVSLSTDDPLQFHFTKEPLMEEYSIATQVWKLSSCDMCELARNSVLMSGFSHKVKSHWLGPNYTKEGPEGNDIRRTNVPDIRVGYRYETLCQELALITQAVQSEMLETIPEEAGITMSPGPQ

SEQ ID NO: 36664 - protein, 1 aa, Homo sapiens
M

SEQ ID NO: 36665 - protein, 879 aa, Homo sapiens; identical to SEQ ID NO: 36660

SEQ ID NO: 36666 - protein, 103 aa, Homo sapiens
MASEARGGLGAPPLQSARSLPGPAPCLKHFPLDLRTSMDGKCKEIAEELFTRSLAESELRSAPYEFPEESPIEQLEERRQRLERQISQDVKLEPDILLRAKQD

SEQ ID NO: 36667 - protein, 767 aa, Homo sapiens
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 36668 - protein, 776 aa, Homo sapiens
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 36669 - protein, 608 aa, Homo sapiens
MIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 36670 - protein, 267 aa, Homo sapiens
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITD

SEQ ID NO: 36671 - protein, 774 aa, Homo sapiens
MEPGSAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 36672 - protein, 767 aa, Homo sapiens; identical to SEQ ID NO: 36667

SEQ ID NO: 36673 - protein, 111 aa, Homo sapiens
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTP

SEQ ID NO: 36674 - protein, 432 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 36675 - protein, 404 aa, Homo sapiens
MPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 36676 - protein, 265 aa, Homo sapiens
MFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 36677 - protein, 305 aa, Homo sapiens
MEAAHFFEGTEKLLEVWFSRQQPDANQGSGDLRTIPSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 36678 - protein, 186 aa, Homo sapiens
MGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 36679 - protein, 334 aa, Homo sapiens
MEAAHFFEGTEKLLEVWFSRQQPDANQGSGDLRTIPRSEWDILLKDVQCSIISVTKTDKQEAYVLSESSMFVSKRRFILKTCGTTLLLKALVPLLKLARDYSGFDSIQSFFYSRKNFMKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 36680 - protein, 214 aa, Homo sapiens
MEAAHFFEGTEKLLEVWFSRQQPDANQGSGDLRTIPRYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 36681 - protein, 1119 aa, Homo sapiens
MAGAPRGGGGGGGGAGEPGGAERAAGTSRRRGLRACDEEFACPELEALFRGYTLRLEQAATLKALAVLSLLAGALALAELLGAPGPAPGLAKGSHPVHCVLFLALLVVTNVRSLQVPQLQQVGQLALLFSLTFALLCCPFALGGPARGSAGAAGGPATAEQGVWQLLLVTFVSYALLPVRSLLAIGFGLVVAASHLLVTATLVPAKRPRLWRTLGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKAKKSISSHLSTLADFAIEMFDVLDEINYQSYNDFVLRVGINVGPVVAGVIGARRPQYDIWGNTVNVASRMDSTGVQGRIQVTEEVHRLLRRCPYHFVCRGKVSVKGKGEMLTYFLEGRTDGNGSQIRSLGLDRKMCPFGRAGLQGRRPPVCPMPGVSVRAGLPPHSPGQYLPSAAAGKEA

SEQ ID NO: 36682 - protein, 1057 aa, Homo sapiens
MAGAPRGGGGGGGGAGEPGGAERAAGTSRRRGLRACDEEFACPELEALFRGYTLRLEQAATLKALAVLSLLAGALALAELLGAPGPAPGLAKGSHPVHCVLFLALLVVTNVRSLQVPQLQQVGQLALLFSLTFALLCCPFALGGPARGSAGAAGGPATAEQGVWQLLLVTFVSYALLPVRSLLAIGFGLVVAASHLLVTATLVPAKRPRLWRTLGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKAKKSISSHLSTLADFAIEMFDVLDEINYQSYNDFVLRVGINVGPVVAGVIGARRPQYDIWGNTVNVASRMDSTGVQGRIQVTEEVHRLLRRCPPLCVPRQSQCQGQRRDVDILSRRQD

SEQ ID NO: 36683 - protein, 1091 aa, Homo sapiens
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLVWQILANVIIFICGNLAGAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 36684 - protein, 203 aa, Homo sapiens
MENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGVTEETSLVLQTLGYTCTCRGIINVKGKGDLKTYFVNTEMSRSLSQSNVAS

SEQ ID NO: 36685 - protein, 911 aa, Homo sapiens
MDLRWARDLHLREASRSVAFTTLRLGAVTTGLLTFREPGDKEKSGKGLGKRWRIQREESQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 36686 - protein, 924 aa, Homo sapiens
MLPFNMRDAIIASVLTSSSHTIVLSVCLSATPGGKEHLVWQILANVIIFICGNLAGAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 36687 - protein, 1144 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 36688 - protein, 1119 aa, Homo sapiens
MPRNQGFSEPEYSAEYSAEYSVSLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 36689 - protein, 112 aa, Homo sapiens
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAG

SEQ ID NO: 36690 - protein, 1077 aa, Homo sapiens
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKEHECMRIKILGDCYYCVSGLPLSLPDHAINCVRMGLDMCRAIRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 36691 - protein, 419 aa, Homo sapiens
MSRGTRESACCMLTSWASRGWPASVPLRSWCSCSMSSLASSTRLPRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPVSVPTCP

SEQ ID NO: 36692 - protein, 1077 aa, Homo sapiens; identical to SEQ ID NO: 36690

SEQ ID NO: 36693 - protein, 1077 aa, Homo sapiens; identical to SEQ ID NO: 36690

SEQ ID NO: 36694 - protein, 115 aa, Homo sapiens
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVS

SEQ ID NO: 36695 - protein, 911 aa, Homo sapiens
MKSQKEGCCSRGDLSIQTGPGGEWAPRRLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 36696 - protein, 1261 aa, Homo sapiens
MSGSKSVSPPGYAAQKTAAPAPRGGPEHRSAWGEADSRANGYPHAPGGSARGSTKKPGGAVTPQQQQRLASRWRSDDDDDPPLSGDDPLAGGFGFSFRSKSAWQERGGDDCGRGSRRQRRGAASGGSTRAPPAGGGGGSAAAAASAGGTEVRPRSVEVGLEERRGKGRAADELEAGAVEGGEGSGDGGSSADSGSGAGPGAVLSLGACCLALLQIFRSKKFPSDKLERLYQRYFFRLNQSSLTMLMAVLVLVCLVMLAFHAARPPLQLPYLAVLAAAVGVILIMAVLCNRAAFHQDHMGLACYALIAVVLAVQVVGLLLPQPRSASEGIWWTVFFIYTIYTLLPVRMRAAVLSGVLLSALHLAIALRTNAQDQFLLKQLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 36697 - protein, 919 aa, Homo sapiens
MAPSRFRTQLELVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQWSLCENLRHRRMEAGTYFPSGVKEQSPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 36698 - protein, 1168 aa, Homo sapiens
MSWFSGLLVPKVDERKTAWGERNGQKRSRRRGTRAGGFCTPRYMSCLRDAEPPSPTPAGPPRCPWQDDAFIRRGGPGKGKELGLRAVALGFEDTEVTTTAGGTAEVAPDAVPRSGRSCWRRLVQVFQSKQFRSAKLERLYQRYFFQMNQSSLTLLMAVLVLLTAVLLAFHAAPARPQPAYVALLACAAALFVGLMVVCNRHSFRQDSMWVVSYVVLGILAAVQVGGALAADPRSPSAGLWCPVFFVYIAYTLLPIRMRAAVLSGLGLSTLHLILAWQLNRGDAFLWKQLGANVLLFLCTNVIGICTHYPAEVSQRQAFQETRGYIQARLHLQHENRQQERLLLSVLPQHVAMEMKEDINTKKEDMMFHKIYIQKHDNVSILFADIEGFTSLASQCTAQELVMTLNELFARFDKLAAENHCLRIKILGDCYYCVSGLPEARADHAHCCVEMGVDMIEAISLVREVTGVNVNMRVGIHSGRVHCGVLGLRKWQFDVWSNDVTLANHMEAGGRAGRIHITRATLQYLNGDYEVEPGRGGERNAYLKEQHIETFLILGASQKRKEEKAMLAKLQRTRANSMEGLMPRWVPDRAFSRTKDSKAFRQMGIDDSSKDNRGTQDALNPEDEVDEFLSRAIDARSIDQLRKDHVRRFLLTFQREDLEKKYSRKVDPRFGAYVACALLVFCFICFIQLLIFPHSTLMLGIYASIFLLLLITVLICAVYSCGSLFPKALQRLSRSIVRSRAHSTAVGIFSVLLVFTSAIANMFTCNHTPIRSCAARMLNLTPADITACHLQQLNYSLGLDAPLCEGTMPTCSFPEYFIGNMLLSLLASSVFLHISSIGKLAMIFVLGLIYLVLLLLGPPATIFDNYDLLLGVHGLASSNETFDGLDCPAAGRVALKYMTPVILLVFALALYLHAQQVESTARLDFLWKLQATGEKEEMEELQAYNRRLLHNILPKDVAAHFLARERRNDELYYQSCECVAVMFASIANFSEFYVELEANNEGVECLRLLNEIIADFDEIISEERFRQLEKIKTIGSTYMAASGLNASTYDQVGRSHITALADYAMRLMEQMKHINEHSFNNFQMKIGLNMGPVVAGVIGARKPQYDIWGNTVNVSSRMDSTGVPDRIQVTTDLYQVLAAKGYQLECRGVVKVKGKGEMTTYFLNGGPSS

SEQ ID NO: 36699 - protein, 1115 aa, Homo sapiens
MSWFSGLLVPKVDERKTAWGERNGQKRSRRRGTRAGGFCTPRYMSCLRDAEPPSPTPAGPPRCPWQDDAFIRRGGPGKGKELGLRAVALGFEDTEVTTTAGGTAEVAPDAVPRSGRSCWRRLVQVFQSKQFRSAKLERLYQRYFFQMNQSSLTLLMAVLVLLTAVLLAFHAAPARPQPAYVALLACAAALFVGLMVVCNRHSFRQDSMWVVSYVVLGILAAVQVGGALAADPRSPSAGLWCPVFFVYIAYTLLPIRMRAAVLSGLGLSTLHLILAWQLNRGDAFLWKQLGANVLLFLCTNVIGICTHYPAEVSQRQAFQETRGYIQARLHLQHENRQQERLLLSVLPQHVAMEMKEDINTKKEDMMFHKIYIQKHDNVSILFADIEGFTSLASQCTAQELVMTLNELFARFDKLAAENHCLRIKILGDCYYCVSGLPEARADHAHCCVEMGVDMIEAISLVREVTGVNVNMRVGIHSGRVHCGVLGLRKWQFDVWSNDVTLANHMEAGGRAGRIHITRATLQYLNGDYEVEPGRGGERNAYLKEQHIETFLILGASQKRKEEKAMLAKLQRTRANSMEGLMPRWVPDRAFSRTKDSKAFRQMGIDDSSKDNRGTQDALNPEDEVDEFLSRAIDARSIDQLRKDHVRRFLLTFQREDLEKKYSRKVDPRFGAYVACALLVFCFICFIQLLIFPHSTLMLGIYASIFLLLLITVLICAVYSCGSLFPKALQRLSRSIVRSRAHSTAVGIFSVLLVFTSAIANMYFIGNMLLSLLASSVFLHISSIGKLAMIFVLGLIYLVLLLLGPPATIFDNYDLLLGVHGLASSNETFDGLDCPAAGRVALKYMTPVILLVFALALYLHAQQVESTARLDFLWKLQATGEKEEMEELQAYNRRLLHNILPKDVAAHFLARERRNDELYYQSCECVAVMFASIANFSEFYVELEANNEGVECLRLLNEIIADFDEIISEERFRQLEKIKTIGSTYMAASGLNASTYDQVGRSHITALADYAMRLMEQMKHINEHSFNNFQMKIGLNMGPVVAGVIGARKPQYDIWGNTVNVSSRMDSTGVPDRIQVTTDLYQVLAAKGYQLECRGVVKVKGKGEMTTYFLNGGPSS

SEQ ID NO: 36700 - protein, 1115 aa, Homo sapiens; identical to SEQ ID NO: 36699

SEQ ID NO: 36701 - protein, 1080 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFIGDKLNEDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 36702 - protein, 1080 aa, Homo sapiens; identical to SEQ ID NO: 36701

SEQ ID NO: 36703 - protein, 433 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKALLLQVR

SEQ ID NO: 36704 - protein, 734 aa, Homo sapiens
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPHLHTVFSRLNELTS

SEQ ID NO: 36705 - protein, 1251 aa, Homo sapiens
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 36706 - protein, 1353 aa, Homo sapiens
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 36707 - protein, 176 aa, Homo sapiens
MTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 36708 - protein, 176 aa, Homo sapiens; identical to SEQ ID NO: 36707

SEQ ID NO: 36709 - protein, 315 aa, Homo sapiens
MLTKRALQKPCSDRFLRTAQINRSRRPVTSVTSGSSSRSRASPHRPLFLSSASLSAPPSLRVTLPPGSARLQTFEQNTSLGKRVPQLLLLLPLVPAASAQTPTPDGDASRVVTPAQELEEALCPPSYLAALLAAGGVEGMTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 36710 - protein, 176 aa, Homo sapiens; identical to SEQ ID NO: 36707

SEQ ID NO: 36711 - protein, 468 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 36712 - protein, 197 aa, Homo sapiens
MVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLTNLSPRVPKKAREDPLPVPSDQHSLPFLSCVQKCYCKPQRAQQHSCKMSELSTITLRLARSTLLLIPLFGIHYTVFA

SEQ ID NO: 36713 - protein, 496 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYFSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 36714 - protein, 524 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLTNLSPRVPKKAREDPLPVPSDQHSLPFLSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 36715 - protein, 74 aa, Homo sapiens
MAGVVHVSLAALLLLPMAPAMHSDCIFKKEQAMCLEKIQRANELMGFNDSSPGCPGMWDNITCWKPAHVGEMVL

SEQ ID NO: 36716 - protein, 148 aa, Homo sapiens
  MOD_RES (1)..(1): Any amino acid
XATLRLYFDDTGCWDMNDSTALWWVIKGPVVGSIMVNFVLFIGIIVILVQKLQSPDMGGNESSIYLTNLSPRVPKKAREDPLPVPSDQHSLPFLRLARSTLLLIPLFGIHYTVFAFSPENVSKRERLVFELGLGSFQGFVVAVLYCFL

SEQ ID NO: 36717 - protein, 447 aa, Homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 36718 - protein, 210 aa, Homo sapiens
MGCCSSSDPRREDDLRAREKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 36719 - protein, 194 aa, Homo sapiens
MEEKLKKTKIIFVVGGPGSGKGTQCEKIVQKYGYTHLSTGDLLRSEVSSGSARGKKLSEIMEKGQLVPLETVLDMLRDAMVAKVNTSKGFLIDGYPREVQQGEEFERRIGQPTLLLYVDAGPETMTQRLLKRGETSGRVDDNEETIKKRLETYYKATEPVIAFYEKRGIVRKVNAEGSVDSVFSQVCTHLDALK

SEQ ID NO: 36720 - protein, 194 aa, Homo sapiens; identical to SEQ ID NO: 36719

SEQ ID NO: 36721 - protein, 239 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 36722 - protein, 232 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 36723 - protein, 202 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSVIGQAKRSFLRLAKISFDVLIKKALA

SEQ ID NO: 36724 - protein, 157 aa, Homo sapiens
MTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 36725 - protein, 227 aa, Homo sapiens
MGASARLLRAVIMGAPGSGKGTVSSRITTHFELKHLSSGDLLRDNMLRGTEIGVLAKAFIDQGKLIPDDVMTRLALHELKNLTQYSWLLDGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 36726 - protein, 187 aa, Homo sapiens
MGASARLLRAVIMGAPGSGKGTVSSRITTHFELKHLSSGDLLRDNMLRGTGFPRTLPQAEALDRAYQIDTVINLNVPFEVIKQRLTARWIHPASGRVYNIEFNPPKTVGIDDLTGEPLIQREDDKPETVIKRLKAYEDQTKPVLEYYQKKGVLETFSGTETNKIWPYVYAFLQTKVPQRSQKASVTP

SEQ ID NO: 36727 - protein, 157 aa, Homo sapiens; identical to SEQ ID NO: 36724

SEQ ID NO: 36728 - protein, 536 aa, Homo sapiens
MCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIF

SEQ ID NO: 36729 - protein, 562 aa, Homo sapiens
MNTNDAKEYLARREIPQLFESLLNGLMCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIF

SEQ ID NO: 36730 - protein, 176 aa, Homo sapiens
MCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEI

SEQ ID NO: 36731 - protein, 484 aa, Homo sapiens
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 36732 - protein, 425 aa, Homo sapiens
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTDLIILRNALDLLLPKLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQVQRFLEEEVYPLLKPYESVMKVKAELCL

SEQ ID NO: 36733 - protein, 498 aa, Homo sapiens
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTSLILSRGVIKAYCNLRLPGSDSSPVSVSQLARVISRLADFAKERASLPTLGFTHFQPAQLTTVGKRCCLWIQDLCMDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 36734 - protein, 304 aa, Homo sapiens
MDLQNLKRVRDDLRFRGVKGTTGTQASFLQLFEGDDHKVEQLDKMVTEKAGFKRAFIITGQTYTRKVDIEVLSVLASLGASVHKICTDIRLLANLKEMEEPFEKQQIGSSAMPYKRNPMRSERCCSLARHLMTLVMDPLQTASVQWFERTLDDSANRRICLAEAFLTADTILNTLQNISEGLVVYPKVIERRIRQELPFMATENIIMAMVKAGGSRQDCHEKIRVLSQQAASVVKQEGGDNDLIERIQVDAYFSPIHSQLDHLLDPSSFTGRASQQVQRFLEEEVYPLLKPYESVMKVKAELCL

SEQ ID NO: 36735 - protein, 127 aa, Homo sapiens
MAAGGDHGSPDSYRSPLASRYASPEMCFVFSDRYKFRTWRQLWLWLAEAEQTLGLPITDEQIQEMKSNLENIDFKMAAEEEKRLRHDVMAHVHTFGHCCPKAAGIIHLGATSCYVGDNTVGACVVYT

SEQ ID NO: 36736 - protein, 456 aa, Homo sapiens
MAFAETYPAASSLPNGDCGRPRARPGGNRVTVVLGAQWGDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 36737 - protein, 435 aa, Homo sapiens
MAFAETYPAASSLPNGDCDEGKGKVVDLLAQDADIVCRCQGGNNAGHTVVVDSVEYDFHLLPSGIINPNVTAFIGNGVVIHLPGLFEEAEKNVQKGKGLEGWEKRLIISDRAHIVFDFHQAADGIQEQQRQEQAGKNLGTTKKGIGPVYSSKAARSGLRMCDLVSDFDGFSERFKVLANQYKSIYPTLEIDIEGELQKLKGYMEKIKPMVRDGVYFLYEALHGPPKKILVEGANAALLDIDFGTYPFVTSSNCTVGGVCTGLGMPPQNVGEVYGVVKAYTTRVGIGAFPTEQDNEIGELLQTRGREFGVTTGRKRRCGWLDLVLLKYAHMINGFTALALTKLDILDMFTEIKVGVAYKLDGEIIPHIPANQEVLNKVEVQYKTLPGWNTDISNARAFKELPVNAQNYVRFIEDELQIPVKWIGVGKSRESMIQLF

SEQ ID NO: 36738 - protein, 411 aa, Homo sapiens
MWIQQLLGLSSMSIRWPGRPLGSHAWILIAMFQLAVDLPACEALGPGPEFWLLPRSPPRPPRLWSFRSGQPARVPAPVWSPRPPRVERIHGQMQMPRARRAHRPRDQAAALVPKAGLAKPPAAAKSSPSLASSSSSSSSAVAGGAPEQQALLRRGKRHLQGDGLSSFDSRGSRPTTETEFIAWGPTGDEEALESNTFPGVYGPTTVSILQTRKTTVAATTTTTTTATPMTLQTKGFTESLDPRRRIPGGVSTTEPSTSPSNNGEVTQPPRILGEASGLAVHQIITITVSLIMVIAALITTLVLKNCCAQSGNTRRNSHQRKTNQQEESCQNLTDFPSARVPSSLDIFTAYNETLQCSHECVRASVPVYTDETLHSTTGEYKSTFNGNRPSSSDRHLIPVAFVSEKWFEISC

SEQ ID NO: 36739 - protein, 411 aa, Homo sapiens; identical to SEQ ID NO: 36738

SEQ ID NO: 36740 - protein, 384 aa, Homo sapiens
MVSGDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 36741 - protein, 394 aa, Homo sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 36742 - protein, 155 aa, Homo sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGC

SEQ ID NO: 36743 - protein, 220 aa, Homo sapiens
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRKW

SEQ ID NO: 36744 - protein, 375 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 36745 - protein, 171 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLATAHLPLHRLCPGHFCHHCGAVGPVCHS

SEQ ID NO: 36746 - protein, 266 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQT

SEQ ID NO: 36747 - protein, 205 aa, Homo sapiens
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFS

SEQ ID NO: 36748 - protein, 375 aa, Homo sapiens; identical to SEQ ID NO: 36744

SEQ ID NO: 36749 - protein, 386 aa, Homo sapiens
MNEPTENRLGCSRTPEPDIRLRKGHQLDGTRRGDNDSHQGDLEPILEASVLSSHHKKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVFFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 36750 - protein, 244 aa, Homo sapiens
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 36751 - protein, 244 aa, Homo sapiens; identical to SEQ ID NO: 36750

SEQ ID NO: 36752 - protein, 244 aa, Homo sapiens; identical to SEQ ID NO: 36750

SEQ ID NO: 36753 - protein, 496 aa, Homo sapiens
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 36754 - protein, 346 aa, Homo sapiens
MGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVASSCGWDTGLRHRNHRHQPSVSEGTPRVHDFPFGGRLQDCIKPKQASSRMAQRGNILPLHTSIGV

SEQ ID NO: 36755 - protein, 416 aa, Homo sapiens
MALWRGSAYAGFLALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 36756 - protein, 222 aa, Homo sapiens
MAASCRVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 36757 - protein, 181 aa, Homo sapiens
MGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 36758 - protein, 181 aa, Homo sapiens; identical to SEQ ID NO: 36757

SEQ ID NO: 36759 - protein, 181 aa, Homo sapiens; identical to SEQ ID NO: 36757

SEQ ID NO: 36760 - protein, 172 aa, Homo sapiens
MGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAQDELRDAVLLVFANKQDLPNAMNAAEITDKLGLHSLRHRNWYIQATCATSGDGLYEGLDWLSNQLRNQK

SEQ ID NO: 36761 - protein, 181 aa, Homo sapiens
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 36762 - protein, 144 aa, Homo sapiens
MGNIFGNLLKSLIGKKEMRILMVGLDAAGKTTILYKLKLGEIVTTIPTIGLIFVVDSNDRERVNEAREELMRMLAEDELRDAVLLVFANKQDLPNAMNAAEITDKLGLHSLRHRNWYIQATCATSGDGLYEGLDWLANQLKNKK

SEQ ID NO: 36763 - protein, 50 aa, Homo sapiens
MGNIFGNLLKSLIGKKEMRILMVGLDAAGKTTILYKLKLGEIVTTIPTIG

SEQ ID NO: 36764 - protein, 102 aa, Homo sapiens
MGNIFGNLLKSLIGKKEMRILMVGLDAAGKTTILYKLKLGEIVTTIPTIGFNVETVEYKNISFTVWDVGGQDKIRPLWRHYFQNTQGLIFVVDSNDRERVNE

SEQ ID NO: 36765 - protein, 181 aa, Homo sapiens; identical to SEQ ID NO: 36761

SEQ ID NO: 36766 - protein, 40 aa, Homo sapiens
MGNIFGNLLKSLIGKKEMRILMVGLDAAGKTTILYKLKLG

SEQ ID NO: 36767 - protein, 180 aa, Homo sapiens
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 36768 - protein, 127 aa, Homo sapiens
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANK

SEQ ID NO: 36769 - protein, 22 aa, Homo sapiens
MGLTISSLFSRLFGKKQMRILM

SEQ ID NO: 36770 - protein, 180 aa, Homo sapiens
MGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVQESADELQKMLQEDELRDAVLLVFANKQDMPNAMPVSELTDKLGLQHLRSRTWYVQATCATQGTGLYDGLDWLSHELSKR

SEQ ID NO: 36771 - protein, 414 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKFWGHKQQPEPASELGHSLNENVLKPAQEKVKEGKIFDDVSSGVSQLASKGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 36772 - protein, 403 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKCQRRLCCHQSHCSAGHLGRAFCPVSWHEALCGQTGREEQASLLPPKHVVGALEVCARGCPRCHVPHTPGTAAEWPGRLCLSRESVVRDGGTSPPFFRGKQRAPWTAPRRATVIRTAVWTTSKTAT

SEQ ID NO: 36773 - protein, 406 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 36774 - protein, 293 aa, Homo sapiens
MLSSESSWSLRRITILAGPCRRSTTAEPRPSLGIRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKEGKIFDDVSSGVSQLASKVQGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 36775 - protein, 361 aa, Homo sapiens
MRTTFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKFWGHKQQPEPASELGHSLNENVLKPAQEKVKEGKIFDDVSSGVSQLASKGVGSKGWRDVTTFFSGKAEGPLDSPSEGHSYQNSGLDHFQNSNIDQSFWETFGSAEPTKTRKSPSSDSWTCADTSTERRSSDSWEVWGSASTNRNSNSDGGEGGEGTKKAVPPAVPTDDGWDNQNW

SEQ ID NO: 36776 - protein, 261 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPAQEKVKE

SEQ ID NO: 36777 - protein, 79 aa, Homo sapiens
MASPRTRKVLKEVRVQDENNVCFECGAFNPQWVSVTYGIWICLECSGRHRGLGVHLSFVRSVTMDKWKDIELEKMKAGG

SEQ ID NO: 36778 - protein, 122 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGR

SEQ ID NO: 36779 - protein, 252 aa, Homo sapiens
MVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 36780 - protein, 414 aa, Homo sapiens
MQVGGNANATAFFRQHGCTANDANTKYNSRAAQMYREKIRQLGSAALARHGTDPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 36781 - protein, 385 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANALGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 36782 - protein, 521 aa, Homo sapiens
MAAEPNKTEIQTLFKRLRAVPTNKACFDCGAKNPSWASITYGVFLCIDCSGVHRSLGVHLSFIRSTELDSNWNWFQLRCMQVGGNANATAFFRQHGCTANDANTKYNSRAAQMYREKIRQLGSAALARHGTDLWIDNMSSAVPNHSPEKKDSDFFTEHTQPPAWDAPATEPSGTQQPAPSTESSGLAQPEHGPNTDLLGTSPKASLELKSSIIGKKKPAAAKKGLGAKKGLGAQKVSSQSFSEIERQAQVAEKLREQQAADAKKQAEESMVASMRLAYQELQIDRKKEEKKLQNLEGKKREQAERLGMGLVSRSSVSHSVLSEMQVIEQETPVSAKSSRSQLDLFDDVGTFASGPPKYKDNPFSLGESFGSRWDTDAAWGMDRVEEKEPEVTISSIRPISERATNRREVESRSSGLESSEARQKFAGAKAISSDMFFGREVDAEYEARSRLQQLSGSSAISSSDLFGDMDGAHGAGSVSLGNVLPTADIAQFKQGVKSVAGKMAVLANGVMNSLQDRYGSY

SEQ ID NO: 36783 - protein, 516 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASASSFFHQHGCSTNDTNAKYNSRAAQLYREKIKSLASQATRKHGTDLWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSSYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 36784 - protein, 444 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASAVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSSYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 36785 - protein, 472 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASALWLDSCVVPPLSPPPKEEDFFASHVSPEVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSSYFDEPVELRSSSFSSWDDSSDSYWKKETSKDTETVLKTTGYSDRPTARRKPDYEPVENTDEAQKKFGNVKAISSDMYFGRQSQADYETRARLERLSASSSISSADLFEEPRKQPAGNYSLSSVLPNAPDMAQFKQGVRSVAGKLSVFANGVVTSIQDRYGS

SEQ ID NO: 36786 - protein, 273 aa, Homo sapiens
  MOD_RES (1)..(1): Any amino acid
XLALFQVSDTAWASAIAEPSSLTSRPVETTLENNEGGQEQGPSVEGLNVPTKATLEVSSIIKKKPNQAKKGLGAKKGSLGAQKLANTCFNEIEKQAQAADKMKEQEDLAKVVSKEESIVSSLRLAYKDLEIQMKKDEKMNISGKKNVDSDRLGMGFGNCRSVISHSVTSDMQTIEQESPIMAKPRKKYNDDSDDSYFTSSSRPTARRKPDYEPVENTDEAQKKFGNVKAISSDMYFGRQSQADYETRARLERLSASSSISSADLFEEPRKQPA

SEQ ID NO: 36787 - protein, 152 aa, Homo sapiens
MGDPSKQDILTIFKRLRSVPTNKVCFDCGAKNPSWASITYGVFLCIDCSGSHRSLGVHLSFIRSTELDSNWSWFQLRCMQVGGNASAVSDTAWASAIAEPSSLTSRPVETTLENNEGGQEQGPSVEGLNVPTKATLEVSSIIKKKPNQAKKG

SEQ ID NO: 36788 - protein, 1849 aa, Homo sapiens
MYEGKKTKNMFLTRALEKILADKEVKKAHHSQLRKACEVALEEIKAETEKQSPPHGEAKAGSSTLPPVKSKTNFIEADKYFLPFELACQSKCPRIVSTSLDCLQKLIAYGHLTGNAPDSTTPGKKLIDRIIETICGCFQGPQTDEGVQLQIIKALLTAVTSQHIEIHEGTVLQAVRTCYNIYLASKNLINQTTAKATLTQMLNVIFARMENQALQEAKQMEKERHRQHHHLLQSPVSHHEPESPQLRYLPPQTVDHISQEHEGDLDLHTNDVDKSLQDDTEPENGSDISSAENEQTEADQATAAETLSKNEVLYDGENHDCEEKPQDIVQNIVEEMVNIVVGDMGEGTTINASADGNIGTIEDGSDSENIQANGIPGTPISVAYTPSLPDDRLSVSSNDTQESGNSSGPSPGAKFSHILQKDAFLVFRSLCKLSMKPLSDGPPDPKSHELRSKILSLQLLLSILQNAGPIFRTNEMFINAIKQYLCVALSKNGVSSVPEVFELSLSIFLTLLSNFKTHLKMQIEVFFKEIFLYILETSTSSFDHKWMVIQTLTRICADAQSVVDIYVNYDCDLNAANIFERLVNDLSKIAQGRGSQELGMSNVQELSLRKKGLECLVSILKCMVEWSKDQYVNPNSQTTLGQEKPSEQEMSEIKHPETINRYGSLNSLESTSSSGIGSYSTQMSGTDNPEQFEVLKQQKEIIEQGIDLFNKKPKRGIQYLQEQGMLGTTPEDIAQFLHQEERLDSTQVGEFLGDNDKFNKEVMYAYVDQHDFSGKDFVSALRMFLEGFRLPGEAQKIDRLMEKFAARYLECNQGQTLFASADTAYVLAYSIIMLTTDLHSPQVKNKMTKEQYIKMNRGINDSKDLPEEYLSAIYNEIAGKKISMKETKELTIPTKSSKQNVASEKQRRLLYNLEMEQMAKTAKALMEAVSHVQAPFTSATHLEHVRPMFKLAWTPFLAAFSVGLQDCDDTEVASLCLEGIRCAIRIACIFSIQLERDAYVQALARFTLLTVSSGITEMKQKNIDTIKTLITVAHTDGNYLGNSWHEILKCISQLELAQLIGTGVKPRYISGTVRGREGSLTGTKDQAPDEFVGLGLVGGNVDWKQIASIQESIGETSSQSVVVAVDRIFTGSTRLDGNAIVDFVRWLCAVSMDELLSTTHPRMFSLQKIVEISYYNMGRIRLQWSRIWEVIGDHFNKVGCNPNEDVAIFAVDSLRQLSMKFLEKGELANFRFQKDFLRPFEHIMKRNRSPTIRDMVVRCIAQMVNSQAANIRSGWKNIFSVFHLAASDQDESIVELAFQTTGHIVTLVFEKHFPATIDSFQDAVKCLSEFACNAAFPDTSMEAIRLIRHCAKYVSDRPQAFKEYTSDDMNVAPEDRVWVRGWFPILFELSCIINRCKLDVRTRGLTVMFEIMKTYGHTYEKHWWQDLFRIVFRIFDNMKLPEQQTEKAEWMTTTCNHALYAICDVFTQYLEVLSDVLLDDIFAQLYWCVQQDNEQLARSGTNCLENVVILNGEKFTLEIWDKTCNCTLDIFKTTIPHALLTWRPNSGETAPPPPSPVSEKPLDTISQKSVDIHDSIQPRSVDNRPQAPLVSASAVNEEVSKIKSTAKFPEQKLFAALLIKCVVQLELIQTIDNIVFFPATSKKEDAENLAAAQRDAVDFDVRVDTQDQGMYRFLTSQQLFKLLDCLLESHRFAKAFNSNNEQRTALWKAGFKGKSKPNLLKQETSSLACGLRILFRMYMDESRVSAWEEVQQRLLNVCSEALSYFLTLTSESHREAWTNLLLLFLTKVLKISDNRFKAHASFYYPLLCEIMQFDLIPELRAVLRRFFLRIGVVFQISQPPEQELGINKQ

SEQ ID NO: 36789 - protein, 1785 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITEMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 36790 - protein, 832 aa, Homo sapiens
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELFNKKPKRGIQFLQEQGMLGTSVEDIAQFLHQEERLDSTQVGDFLGDSARFNKEVMYAYVDQLDFCEKEFVSALRTFLEGFRLPGEAQKIDRLMEKFAARYIECNQGQTLFASADTAYVLAYSIIMLTTDLHSPQVKNKMTKEQYIKMNRGINDSKDLPEEYLSSIYEEIEGKKIAIKKN

SEQ ID NO: 36791 - protein, 196 aa, Homo sapiens
MGSVNSRGHKAEAQVVMMGLDSAGKTTLLYKLKGHQLVETLPTVGFNVEPLKAPGHVSLTLWDVGGQAPLRASWKDYLEGTDILVYVLDSTDEARLPESAAELTEVLNDPNMAGVPFLVLANKQEAPDALPLLKIRNRLSLERFQDHCWELRGCSALTGEGLPEALQSLWSLLKSRSCMCLQARAHGAERGDSKRS

SEQ ID NO: 36792 - protein, 321 aa, Homo sapiens
MFSLMASCCGWFKRWREPVRLANKQDKEGALGEADVIECLSLEKLVNEHKCLCQIEPCSAISGYGKKIDKSIKKGLYWLLHVIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 36793 - protein, 428 aa, Homo sapiens
MFSLMASCCGWFKRWREPVRKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVLANKQDKEGALGEADVIECLSLEKLVNEHKCLCQIEPCSAISGYGKKIDKSIKKGLYWLLHVIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 36794 - protein, 428 aa, Homo sapiens; identical to SEQ ID NO: 36793

SEQ ID NO: 36795 - protein, 325 aa, Homo sapiens
MEETKEAMSEMLRHPRISGKPILVLANKQDKEGALGEADVIECLSLEKLVNEHKCLCQIEPCSAISGYGKKIDKSIKKGLYWLLHVIARDFDALNERIQKETTEQRALEEQEKQERAERVRKLREERKQNEQEQAELDGTSGLAELDPEPTNPFQPIASVIIENEGKLEREKKNQKMEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 36796 - protein, 149 aa, Homo sapiens
MEKDSDGCHLKHKMEHEQIETQGQVNHNGQKNNEFGLVENYKEALTQQLKNEDETDRPSLESANGKKKTKKLRMKRNHRVEPLNIDDCAPESPTPPPPPPPVGWGTPKVTRLPKLEPLGETHHNDFYRKPLPPLAVPQRPNSDAHDVIS

SEQ ID NO: 36797 - protein, 192 aa, Homo sapiens
MGSLGSKNPQTKQAQVLLLGLDSAGKSTLLYKLKLAKDITTIPTIGFNVEMIELERNLSLTVWDVGGQEKMRTVWGCYCENTDGLVYVVDSTDKQRLEESQRQFEHILKNEHIKNVPVVLLANKQDMPGALTAEDITRMFKVKKLCSDRNWYVQPCCALTGEGLAQGFRKLTGFVKSHMKSRGDTLAFFKQN

SEQ ID NO: 36798 - protein, 184 aa, Homo sapiens
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEERLAGATLLIFANKQDLPGALSSNAIREVLELDSIRSHHWCIQGCSAVTGENLLPGIDWLLDDISSRIFTAD

SEQ ID NO: 36799 - protein, 184 aa, Homo sapiens; identical to SEQ ID NO: 36798

SEQ ID NO: 36800 - protein, 157 aa, Homo sapiens
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEEVLELDSIRSHHWCIQGCSAVTGENLLPGIDWLLDDISSRIFTAD

SEQ ID NO: 36801 - protein, 182 aa, Homo sapiens
MGLLSILRKLKSAPDQEVRILLLGLDNAGKTTLLKQLASEDISHITPTQGFNIKSVQSQGFKLNVWDIGGQRKIRPYWKNYFENTDILIYVIDSADRKRFEETGQELAELLEEEKLSCVPVLIFANKQDLLTAAPASEIAEGLNLHTIRDRVWQIQSCSALTGEGVQDGMNWVCKNVNAKKK

SEQ ID NO: 36802 - protein, 201 aa, Homo sapiens
MGNHLTEMAPTASSFLPHFQALHVVVIGLDSAGKTSLLYRLKFKEFVQSVPTKGFNTEKIRVPLGGSRGITFQVWDVGGQEKLRPLWRSYTRRTDGLVFVVDAAEAERLEEAKVELHRISRASDNQGVPVLVLANKQDQPGALSAAEVEKRLAVRELAAATLTHVQGCSAVDGLGLQQGLERLYEMILKRKKAARGGKKRR

SEQ ID NO: 36803 - protein, 186 aa, Homo sapiens
MGLLDRLSVLLGLKKKEVHVLCLGLDNSGKTTIINKLKPSNAQSQNILPTIGFSIEKFKSSSLSFTVFDMSGQGRYRNLWEHYYKEGQAIIFVIDSSDRLRMVVAKEELDTLLNHPDIKHRRIPILFFANKMDLRDAVTSVKVSQLLCLENIKDKPWHICASDAIKGEGLQEGVDWLQDQIQTVKT

SEQ ID NO: 36804 - protein, 186 aa, Homo sapiens; identical to SEQ ID NO: 36803

SEQ ID NO: 36805 - protein, 121 aa, Homo sapiens
MGLLDRLSVLLGLKKKEVHVLCLGLDNSGKTTIINKLKPSNAQSQNILPTIGFSIEKFKSSSLSFTVFDMSGQGRYRNLWEHYYKEGQAIIFVIDSSDRLRMVVAKEELDTLLNHPDIKHR

SEQ ID NO: 36806 - protein, 186 aa, Homo sapiens; identical to SEQ ID NO: 36803

SEQ ID NO: 36807 - protein, 186 aa, Homo sapiens; identical to SEQ ID NO: 36803

SEQ ID NO: 36808 - protein, 187 aa, Homo sapiens
LRPTWKALSHPAWPEEKNKQILVLGLDGAGKTSVLHSLASNRVQHSVAPTQGFHAVCINTEDSQMEFLEIGGSKPFRSYWEMYLSKGLLLIFVVDSADHSRLPEAKKYLHQLIAANPVLPLVVFANKQDLEAAYHITDIHEALALSEVGNDRKMFLFGTYLTKNGSEIPSTMQDAKDLIAQLAADVQ

SEQ ID NO: 36809 - protein, 360 aa, Homo sapiens
MERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQGRKASTAPGAEASPSPCITERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 36810 - protein, 338 aa, Homo sapiens
MERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKVGVAPLPAIRPQLCL

SEQ ID NO: 36811 - protein, 352 aa, Homo sapiens [sequence omitted]

SEQ ID NO: 36812 - protein, 341 aa, Homo sapiens
MERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 36813 - protein, 188 aa, Homo sapiens
MDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPLLLMFIHASLRLRNLKNKLENKMEGIGLKRTPMGIVLDALEQQEEGINRLTDYISKVKE

SEQ ID NO: 36814 - protein, 136 aa, Homo sapiens
MDVNIAPLRAWDDFFPGSDRFARPDFRDISKWNNRVVSNLLYYQTNYLVVAAMMISIVGFLSPFNMILGGIVVVLVFTGFVWAAHDVRYGGHVGELFPYLHVWRSHGLCVWHYFSFAVDVYPCIVETSEPQEQTGE

SEQ ID NO: 36815 - protein, 272 aa, Homo sapiens
MVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 36816 - protein, 354 aa, Homo sapiens
MEKFKAAMLLGSVGDALGYRNVCKENSTVGMKIQEELQRSGGLDHLVLSPGEWPVSDNTIMHIATAEALTTDYWCLDDLYREMVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 36817 - protein, 176 aa, Homo sapiens
MVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREK

SEQ ID NO: 36818 - protein, 363 aa, Homo sapiens
MAAAAMAAAAGGGAGAARSLSRFRGCLAGALLGDCVGSFYEAHDTVDLTSVLRHVQSLEPDPGTPGSERTEALYYTDDTAMARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 36819 - protein, 283 aa, Homo sapiens
MARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 36820 - protein, 209 aa, Homo sapiens
MRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 36821 - protein, 327 aa, Homo sapiens
MQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRLAQGPARIYLRALGKHSTYNCEYIKDKKCKSGPCHLDNSAMGQSPLSAVWSLLLLLWFLVVRAFPDGPGLL

SEQ ID NO: 36822 - protein, 367 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPAPGPVPVPGPKSHPSASSGKLLLPQFGMVIILISVSAINLFVAL

SEQ ID NO: 36823 - protein, 378 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPEDKSQGNINNPTPGPVPVPGPKSHPSASSGKLLLPQFGMVIILISVSAINLFVAL

SEQ ID NO: 36824 - protein, 389 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPGMKIPEPFPLPEDKSQGNINNPTPGPVPVPGPKSHPSASSGKLLLPQFGMVIILISVSAINLFVAL

SEQ ID NO: 36825 - protein, 129 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDY

SEQ ID NO: 36826 - protein, 175 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGL

SEQ ID NO: 36827 - protein, 202 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLS

SEQ ID NO: 36828 - protein, 107 aa, Homo sapiens
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQE

SEQ ID NO: 36829 - protein, 314 aa, Homo sapiens
MGPLINRCKKILLPTTVPPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGDWLQLRSTGNLSTYNCQLLKASSKKCIPDPIAIASLSFLTSVIIFSKSRV

SEQ ID NO: 36830 - protein, 58 aa, Homo sapiens
MGPLINRCKKILLPTTVPPATMRIWLLGGLLPFLLLLSGLQRPTEGSELPARNASLIL

SEQ ID NO: 36831 - protein, 291 aa, Homo sapiens
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGALGTGDLHMTKRHLQQP

SEQ ID NO: 36832 - protein, 239 aa, Homo sapiens
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGEKRRGCVSAPGVQLGSQSEGASSLPPWKTLLLAPGEFQLSGVGP

SEQ ID NO: 36833 - protein, 291 aa, Homo sapiens; identical to SEQ ID NO: 36831

SEQ ID NO: 36834 - protein, 466 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 36835 - protein, 455 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARRGMDCRYFTKNCREHIKHVNFMMPPWRKGSEC

SEQ ID NO: 36836 - protein, 324 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGTYILKYDVLFWRKGLSVCTRLRERKEIKN

SEQ ID NO: 36837 - protein, 342 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIDEETEAQEGKNDSPSFKQPVHHAAVLGLEVMEKENLEGVSRKDTCGVW

SEQ ID NO: 36838 - protein, 466 aa, Homo sapiens; identical to SEQ ID NO: 36834

SEQ ID NO: 36839 - protein, 372 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGTHTHDMKPASRPRLLSLLPKEGEHETHHWSCDPLSLESTPGAQEPCLTLGFTSLSSIHLTKAQIQHVTVTDTGKTVT

SEQ ID NO: 36840 - protein, 429 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARGHTPMT

SEQ ID NO: 36841 - protein, 475 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARTKSRSVTRLECSGMILAHCNLRLPGSRDSPASASQAAGTTGMCHQADATRPS

SEQ ID NO: 36842 - protein, 370 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIDEVSLCHQAGVQWHDLGSLQPPPPGFKRFSCLSLPSSWDYRDVPPGRRHQAQLIFVFLVETGFHHVGQDDLDLLTS

SEQ ID NO: 36843 - protein, 427 aa, Homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARSSGF

SEQ ID NO: 36844 - protein, 520 aa, Homo sapiens
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 36845 - protein, 572 aa, Homo sapiens
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 36846 - protein, 447 aa, Homo sapiens
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 36847 - protein, 462 aa, Homo sapiens
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 36848 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 36849 - protein, 688 aa, Homo sapiens
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 36850 - protein, 387 aa, Homo sapiens
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRG

SEQ ID NO: 36851 - protein, 477 aa, Homo sapiens
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 36852 - protein, 413 aa, Homo sapiens [sequence omitted]

SEQ ID NO: 36853 - protein, 408 aa, Homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 36854 - protein, 347 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 36855 - protein, 233 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRH

SEQ ID NO: 36856 - protein, 133 aa, Homo sapiens
MKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 36857 - protein, 121 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNWWWSQKVEQ

SEQ ID NO: 36858 - protein, 342 aa, Homo sapiens
MAAGTAVGAWVLVLSLWGAVVGAQNITARIGEPLVLKCKGAPKKPPQRLEWKLGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 36859 - protein, 294 aa, Homo sapiens
MNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIGSVGGSGLGTLALALGILGGLGTAALLIGVILWQRRQRRGEERKAPENQEEEEERAELNQSEEPEAGESSTGGP

SEQ ID NO: 36860 - protein, 435 aa, Homo sapiens
MGAGERVQAPPRAEATAGRGADRARTLEGSRMAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 36861 - protein, 404 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 36862 - protein, 347 aa, Homo sapiens; identical to SEQ ID NO: 36854

SEQ ID NO: 36863 - protein, 342 aa, Homo sapiens; identical to SEQ ID NO: 36858

SEQ ID NO: 36864 - protein, 342 aa, Homo sapiens; identical to SEQ ID NO: 36858

SEQ ID NO: 36865 - protein, 233 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRH

SEQ ID NO: 36866 - protein, 234 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRSLRTFTITASDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALR

SEQ ID NO: 36867 - protein, 234 aa, Homo sapiens; identical to SEQ ID NO: 36866

SEQ ID NO: 36868 - protein, 233 aa, Homo sapiens; identical to SEQ ID NO: 36855

SEQ ID NO: 36869 - protein, 404 aa, Homo sapiens [sequence omitted]

SEQ ID NO: 36870 - protein, 347 aa, Homo sapiens; identical to SEQ ID NO: 36854

SEQ ID NO: 36871 - protein, 233 aa, Homo sapiens; identical to SEQ ID NO: 36855

SEQ ID NO: 36872 - protein, 404 aa, Homo sapiens; identical to SEQ ID NO: 36861

SEQ ID NO: 36873 - protein, 234 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRSLRTFTITASDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALR

SEQ ID NO: 36874 - protein, 363 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 36875 - protein, 342 aa, Homo sapiens; identical to SEQ ID NO: 36858

SEQ ID NO: 36876 - protein, 233 aa, Homo sapiens; identical to SEQ ID NO: 36855

SEQ ID NO: 36877 - protein, 342 aa, Homo sapiens; identical to SEQ ID NO: 36858

SEQ ID NO: 36878 - protein, 234 aa, Homo sapiens; identical to SEQ ID NO: 36866

SEQ ID NO: 36879 - protein, 404 aa, Homo sapiens; identical to SEQ ID NO: 36861

SEQ ID NO: 36880 - protein, 342 aa, Homo sapiens
MAAGTAVGAWVLVLSLWGAVVGAQNITARIGEPLVLKCKGAPKKPPQRLEWKLGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDVSDLERGAGRTRRGGANCRLCGRIRAGNSSPGPGDPGRPGDSRPAHWGHLVAKAATPRRGEEGPRKPGGRGGACRTESVGGT

SEQ ID NO: 36881 - protein, 347 aa, Homo sapiens; identical to SEQ ID NO: 36854

SEQ ID NO: 36882 - protein, 234 aa, Homo sapiens; identical to SEQ ID NO: 36866

SEQ ID NO: 36883 - protein, 404 aa, Homo sapiens; identical to SEQ ID NO: 36861

SEQ ID NO: 36884 - protein, 347 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 36885 - protein, 233 aa, Homo sapiens; identical to SEQ ID NO: 36855

SEQ ID NO: 36886 - protein, 347 aa, Homo sapiens; identical to SEQ ID NO: 36854

SEQ ID NO: 36887 - protein, 234 aa, Homo sapiens; identical to SEQ ID NO: 36866

SEQ ID NO: 36888 - protein, 404 aa, Homo sapiens; identical to SEQ ID NO: 36861

SEQ ID NO: 36889 - protein, 128 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQFENLHNYSL

SEQ ID NO: 36890 - protein, 153 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGILGGLGTAALLIGVILWQRRQRRGEERKAPENQEEEEERAELNQSEEPEAGESSTGGP

SEQ ID NO: 36891 - protein, 294 aa, Homo sapiens; identical to SEQ ID NO: 36859

SEQ ID NO: 36892 - protein, 294 aa, Homo sapiens; identical to SEQ ID NO: 36859

SEQ ID NO: 36893 - protein, 121 aa, Homo sapiens; identical to SEQ ID NO: 36857

SEQ ID NO: 36894 - protein, 435 aa, Homo sapiens; identical to SEQ ID NO: 36860

SEQ ID NO: 36895 - protein, 363 aa, Homo sapiens; identical to SEQ ID NO: 36874

SEQ ID NO: 36896 - protein, 133 aa, Homo sapiens; identical to SEQ ID NO: 36856

SEQ ID NO: 36897 - protein, 128 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQFENLHNYSL

SEQ ID NO: 36898 - protein, 153 aa, Homo sapiens; identical to SEQ ID NO: 36890

SEQ ID NO: 36899 - protein, 435 aa, Homo sapiens; identical to SEQ ID NO: 36860

SEQ ID NO: 36900 - protein, 121 aa, Homo sapiens; identical to SEQ ID NO: 36857

SEQ ID NO: 36901 - protein, 128 aa, Homo sapiens; identical to SEQ ID NO: 36889

SEQ ID NO: 36902 - protein, 294 aa, Homo sapiens; identical to SEQ ID NO: 36859

SEQ ID NO: 36903 - protein, 121 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNWWWSQKVEQ

SEQ ID NO: 36904 - protein, 153 aa, Homo sapiens; identical to SEQ ID NO: 36890

SEQ ID NO: 36905 - protein, 435 aa, Homo sapiens; identical to SEQ ID NO: 36860

SEQ ID NO: 36906 - protein, 121 aa, Homo sapiens; identical to SEQ ID NO: 36857

SEQ ID NO: 36907 - protein, 133 aa, Homo sapiens; identical to SEQ ID NO: 36856

SEQ ID NO: 36908 - protein, 294 aa, Homo sapiens; identical to SEQ ID NO: 36859

SEQ ID NO: 36909 - protein, 133 aa, Homo sapiens; identical to SEQ ID NO: 36856

SEQ ID NO: 36910 - protein, 363 aa, Homo sapiens; identical to SEQ ID NO: 36874

SEQ ID NO: 36911 - protein, 435 aa, Homo sapiens
MGAGERVQAPPRAEATAGRGADRARTLEGSRMAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 36912 - protein, 128 aa, Homo sapiens; identical to SEQ ID NO: 36889

SEQ ID NO: 36913 - protein, 153 aa, Homo sapiens; identical to SEQ ID NO: 36890

SEQ ID NO: 36914 - protein, 363 aa, Homo sapiens; identical to SEQ ID NO: 36874

SEQ ID NO: 36915 - protein, 121 aa, Homo sapiens; identical to SEQ ID NO: 36857

SEQ ID NO: 36916 - protein, 133 aa, Homo sapiens; identical to SEQ ID NO: 36856

SEQ ID NO: 36917 - protein, 128 aa, Homo sapiens; identical to SEQ ID NO: 36889

SEQ ID NO: 36918 - protein, 363 aa, Homo sapiens; identical to SEQ ID NO: 36874

SEQ ID NO: 36919 - protein, 435 aa, Homo sapiens; identical to SEQ ID NO: 36860

SEQ ID NO: 36920 - protein, 153 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGILGGLGTAALLIGVILWQRRQRRGEERKAPENQEEEEERAELNQSEEPEAGESSTGGP

SEQ ID NO: 36921 - protein, 133 aa, Homo sapiens; identical to SEQ ID NO: 36856

SEQ ID NO: 36922 - protein, 294 aa, Homo sapiens; identical to SEQ ID NO: 36859

SEQ ID NO: 36923 - protein, 363 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNSSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGEGFDKVREAEDSPQHM

SEQ ID NO: 36924 - protein, 153 aa, Homo sapiens; identical to SEQ ID NO: 36890

SEQ ID NO: 36925 - protein, 128 aa, Homo sapiens; identical to SEQ ID NO: 36889

SEQ ID NO: 36926 - protein, 819 aa, Homo sapiens
MPLTSAFRAVDNDPGIIVWRIEKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAKIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKGSSGDERAMAKELASLLCDGSENTVAEGQEPAEFWDLLGGKTPYANDKRLQQEILDVQSRLFECSNKTGQFVVTEITDFTQDDLNPTDVMLLDTWDQVFLWIGAEANATEKESALATAQQYLHTHPSGRDPDTPILIIKQGFEPPIFTGWFLAWDPNIWSAGKTYEQLKEELGDAAAIMRITADMKNATLSLNSNDSEPKYYPIAVLLKNQNQELPEDVNPAKKENYLSEQDFVSVFGITRGQFAALPGWKQLQMKKEKGLF

SEQ ID NO: 36927 - protein, 812 aa, Homo sapiens
MSSTGHPGSYKIWGEKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSFNRGDVFLLDLGKVIIQWNGPESNSGERLKAMLLAKDIRDRERGGRAKIGVIEGDKEAASPELMKVLQDTLGRRSIIKPTVPDEIIDQKQKSTIMLYHISDSAGQLAVTEVATRPLVQDLLNHDDCYILDQSGTKIYVWKGKGATKAEKQAAMSKALGFIKMKSYPSSTNVETVNDGAESAMFKQLFQKWSVKDQTMGLGKTFSIGKIAKVFQDKFDVTLLHTKPEVAAQERMVDDGNGKVEVWRIENLELVPVEYQWYGFFYGGDCYLVLYTYEVNGKPHHILYIWQGRHASQDELAASAYQAVEVDRQFDGAAVQVRVRMGTEPRHFMAIFKGKLVIFEGGTSRKGNAEPDPPVRLFQIHGNDKSNTKAVEVPAFASSLNSNDVFLLRTQAEHYLWYGKGSSGDERAMAKELASLLCDGSENTVAEGQEPAEFWDLLGGKTPYANDKRLQQEILDVQSRLFECSNKTGQFVVTEITDFTQDDLNPTDVMLLDTWDQVFLWIGAEANATEKESALATAQQYLHTHPSGRDPDTPILIIKQGFEPPIFTGWFLAWDPNIWSAGKTYEQLKEELGDAAAIMRITADMKNATLSLNSNDSEPKYYPIAVLLKNQNQELPEDVNPAKKENYLSEQDFVSVFGITRGQFAALPGWKQLQMKKEKGLF

SEQ ID NO: 36928 - protein, 157 aa, Homo sapiens
MPLTSAFRAVDNDPGIIVWRIEKMELALVPVSAHGNFYEGDCYVILSTRRVASLLSQDIHFWIGKDSSQDEQSCAAIYTTQLDDYLGGSPVQHREVQYHESDTFRGYFKQGIIYKQGGVASGMKHVETNTYDVKRLLHVKGKRNIRATEVEMSWDSF

SEQ ID NO: 36929 - protein, 952 aa, Homo sapiens
MKFKRRHQAFPSFFKMKVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 36930 - protein, 1278 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 36931 - protein, 1276 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 36932 - protein, 427 aa, Homo sapiens
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVK

SEQ ID NO: 36933 - protein, 1311 aa, Homo sapiens
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 36934 - protein, 599 aa, Homo sapiens
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 36935 - protein, 797 aa, Homo sapiens
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 36936 - protein, 812 aa, Homo sapiens
GAGGRRRRVESLGSSVSRRRASLPGGLSPSRARFPRPPVVACPRLREQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 36937 - protein, 2416 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 36938 - protein, 2431 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 36939 - protein, 2530 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 36940 - protein, 2492 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 36941 - protein, 2530 aa, Homo sapiens; identical to SEQ ID NO: 36939

SEQ ID NO: 36942 - protein, 132 aa, Homo sapiens
MLTAAVLSCALLLALPATRGAQMGLAPMEGIRRPDQALLPELPGLGLRAPLKKTTAEQAEEDLLQEAQALAEVLDLQDREPRSSRRCVRLHESCLGQQVPCCDPCATCYCRFFNAFCYCRKLGTAMNPCSRT

SEQ ID NO: 36943 - protein, 132 aa, Homo sapiens
MDVTRLLLATLLVFLCFFTANSHLPPEEKLRDDRSLRSNSSVNLLDVPSVSIVALNKKSKQIGRKAAEKKRSSKKEASMKKVVRPRTPLSAPCVATRNSCKPPAPACCDPCASCQCRFFRSACSCRVLSLNC

SEQ ID NO: 36944 - protein, 311 aa, Homo sapiens
MALEVVFLARGPSGLLLYNGQKTDGKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNT

SEQ ID NO: 36945 - protein, 2045 aa, Homo sapiens
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 36946 - protein, 271 aa, Homo sapiens
  MOD_RES (1)..(1): Any amino acid
XRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNT

SEQ ID NO: 36947 - protein, 153 aa, Homo sapiens
MALVFVYGTLKRGQPNHRVLRDGAHGSAAFRARGRTLEPYPLVIAGEHNIPWLLHLPGSGRLVEGEVYAVDERMLRFLDDFESCPALYQRTVLRVQLLEDRAPGAEEPPAPTAVQCFVYSRATFPPEWAQLPHHDSYDSEGPHGLRYNPRENR

SEQ ID NO: 36948 - protein, 153 aa, Homo sapiens; identical to SEQ ID NO: 36947

SEQ ID NO: 36949 - protein, 292 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKPEEQHNKSVHVAGLSWVKPGSVQPFSKEEKTVAT

SEQ ID NO: 36950 - protein, 292 aa, Homo sapiens; identical to SEQ ID NO: 36949

SEQ ID NO: 36951 - protein, 392 aa, Homo sapiens
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 36952 - protein, 514 aa, Homo sapiens
MTLIWRHLLRPLCLVTSAPRILEMHPFLSLGTSRTSVTKLSLHTKPRMPPCDFMPERYQSLGYNRVLEIHKEHLSPVVTAYFQKPLLLHQGHMEWLFDAEGSRYLDFFSGIVTVSVGHCHPKVNAVAQKQLGRLWHTSTVFFHPPMHEYAEKLAALLPEPLKVIFLVNSGSEANELAMLMARAHSNNIDIISFRGAYHGCSPYTLGLTNVGTYKMELPGGTGCQPTMCPDVFRGPWGGSHCRDSPVQTIRKCSCAPDCCQAKDQYIEQFKDTLSTSVAKSIAGFFAEPIQGVNGVVQYPKGFLKEAFELVRARGGVCIADEVQTGFGRLGSHFWGFQTHDVLPDIVTMAKGIGNGFPMAAVITTPEIAKSLAKCLQHFNTFGGNPMACAIGSAVLEVIKEENLQENSQEVGTYMLLKFAKLRDEFEIVGDVRGKGLMIGIEMVQDKISCRPLPREEVNQIHEDCKHMGLLVGRGSIFSQTFRIAPSMCITKPEVDFAVEVFRSALTQHMERRAK

SEQ ID NO: 36953 - protein, 968 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKMSNYDTDLFVPYFEAIQKGTGARPYTGKVGAEDADGIDMAYRVLADHARTITVALADGGRPDNTGRGYVLRRILRRAVRYAHEKLNASRGFFATLVDVVVQSLGDAFPELKKDPDMVKDIINEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 36954 - protein, 985 aa, Homo sapiens
MAASVAAAARRLRRAIRRSPAWRGLSHRPLSSEPPAAKASAVRAAFLNFFRDRHGHRLVPSASVRPRGDPSLLFVNAGMNQFKPIFLGTVDPRSEMAGFRRVANSQKCVRAGGHHNDLEDVGRDLSHHTFFEMLGNWAFGGEYFKEEACNMAWELLTQVYGIPEERLWISYFDGDPKAGLDPDLETRDIWLSLGVPASRVLSFGPQENFWEMGDTGPCGPCTEIHYDLAGGVGAPQLVELWNLVFMQHNREADGSLQPLPQRHVDTGMGLERLVAVLQGKHSTYDTDLFSPLLNAIQQGCRAPPYLGRVGVADEGRTDTAYRVVADHIRTLSVCISDGIFPGMSGPPLVLRRILRRAVRFSMEILKAPPGFLGSLVPVVVETLGDAYPELQRNSAQIANLVSEDEAAFLASLERGRRIIDRTLRTLGPSDMFPAEVAWSLSLCGDLGLPLDMVELMLEEKGVQLDSAGLERLAQEEAQHRARQAEPVQKQGLWLDVHALGELQRQGVPPTDDSPKYNYSLRPSGSYEFGTCEAQVLQLYTEDGTAVASVGKGQRCGLLLDRTNFYAEQGGQASDRGYLVRAGQEDVLFPVARAQVCGGFILHEAVAPECLRLGDQVQLHVDEAWRLGCMAKHTATHLLNWALRQTLGPGTEQQGSHLNPEQLRLDVTTQTPLTPEQLRAVENTVQEAVGQDEAVYMEEVPLALTAQVPGLRSLDEVYPDPVRVVSVGVPVAHALDPASQAALQTSVELCCGTHLLRTGAVGDLVIIGDRQLSKGTTRLLAVTGEQAQQARELGQSLAQEVKAATERLSLGSRDVAEALRLSKDIGRLIEAVETAVMPQWQRRELLATVKMLQRRANTAIRKLQMGQAAKKTQELLERHSKGPLIVDTVSAESLSVLVKVVRQLCEQAPSTSVLLLSPQPMGKVLCACQVAQGAMPTFTAEAWALAVCSHMGGKAWGSRVVAQGTGSTTDLEAALSIAQTYALSQL

SEQ ID NO: 36955 - protein, 525 aa, Homo sapiens
MEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 36956 - protein, 586 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 36957 - protein, 586 aa, Homo sapiens; identical to SEQ ID NO: 36956

SEQ ID NO: 36958 - protein, 412 aa, Homo sapiens
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDTPSMTAEQVAAIEQSVNEKIRDRLPVNVRELSLDDPEVEQVSGRGLPDDHAGPIRVVNIEGVDSNMCCGTHVSNLSDLQVIKILGTEKGKKNRTNLIFLSGNRVLKWMERSHGTEKALTALLKCGAEDHVEAVKKLQNSTKILQKNNLNLLRDLAVHIAHSLRNSPDWGGVVILHRKEGDSEFMNIIANEIGSEETLLFLTVGDEKGGGLFLLAGPPASVETLGPRVAEVLEGKGAGKKGRFQGKATKMSRRMEAQALLQDYISTQSAKE

SEQ ID NO: 36959 - protein, 166 aa, Homo sapiens
MFSLPLNCSPDHIRRGSCWGRPQDLKIAAPAWNSKCHPGAGAAMARQHARTLWYDRPRYVFMEFCVEDSTDVHVLIEDHRIVFSCKNADGVELYNEIEFYAKVNSKPVWLSVDFDNWRDWEGDEEMELAHVEHYAELLKKVSTKRPPPAMDDLDDDSDSADDATSN

SEQ ID NO: 36960 - protein, 132 aa, Homo sapiens
MEFCVEDSTDVHVLIEDHRIVFSCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDFTTTVV

SEQ ID NO: 36961 - protein, 609 aa, Homo sapiens [sequence omitted]

SEQ ID NO: 36962 - protein, 396 aa, Homo sapiens
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 36963 - protein, 417 aa, Homo sapiens
MKWVTFISLLFLFSSAYSRGVFRRDAHKSEVAHRFKDLGEENFKALAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 36964 - protein, 618 aa, Homo sapiens
MKWVTFISLLFLFSSAYSRGVFRRDALFLFFFPCPDKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 36965 - protein, 375 aa, Homo sapiens
MSTAGKVIKCKAAVLWELKKPFSIEEVEVAPPKAHEVRIKMVAVGICGTDDHVVSGTMVTPLPVILGHEAAGIVESVGEGVTTVKPGDKVIPLAIPQCGKCRICKNPESNYCLKNDVSNPQGTLQDGTSRFTCRRKPIHHFLGISTFSQYTVVDENAVAKIDAASPLEKVCLIGCGFSTGYGSAVNVAKVTPGSTCAVFGLGGVGLSAIMGCKAAGAARIIAVDINKDKFAKAKELGATECINPQDYKKPIQEVLKEMTDGGVDFSFEVIGRLDTMMASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 36966 - protein, 375 aa, Homo sapiens
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 36967 - protein, 335 aa, Homo sapiens
MVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 36968 - protein, 362 aa, Homo sapiens
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 36969 - protein, 380 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 36970 - protein, 399 aa, Homo sapiens
MLVRGPHFELQRCKTHLFSSNYLTQVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 36971 - protein, 374 aa, Homo sapiens
MANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 36972 - protein, 368 aa, Homo sapiens
MCTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKW

SEQ ID NO: 36973 - protein, 375 aa, Homo sapiens
MCTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCIRCILLL

SEQ ID NO: 36974 - protein, 166 aa, Homo sapiens
MGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCIRCILLL

SEQ ID NO: 36975 - protein, 386 aa, Homo sapiens
MFAEIQIQDKDRMGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 36976 - protein, 374 aa, Homo sapiens
MGTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 36977 - protein, 394 aa, Homo sapiens
MKCLVSRHTVRETLDMVFQRMSVEAGVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 36978 - protein, 317 aa, Homo sapiens
MVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 36979 - protein, 303 aa, Homo sapiens
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVNSTDK

SEQ ID NO: 36980 - protein, 467 aa, Homo sapiens
MAAAARARVAYLLRQLQRAACQCPTHSHTYSQAPGLSPSGKTTDYAFEMAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVRNPDDLEARSHMHLASAFAGIGFGNAGVHLCHGMSYPISGLVKMYKAKDYNVDHPLVPHGLSVVLTSPAVFTFTAQMFPERHLEMAEILGADTRTARIQDAGLVLADTLRKFLFDLDVDDGLAAVGYSKADIPALVKGTLPQERVTKLAPCPQSEEDLAALFEASMKLY

SEQ ID NO: 36981 - protein, 801 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 36982 - protein, 501 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 36983 - protein, 230 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGASVV

SEQ ID NO: 36984 - protein, 238 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMD

SEQ ID NO: 36985 - protein, 329 aa, Homo sapiens
IAEPVTCVPGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRFCGRINL

SEQ ID NO: 36986 - protein, 203 aa, Homo sapiens
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTAL

SEQ ID NO: 36987 - protein, 518 aa, Homo sapiens
MTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 36988 - protein, 480 aa, Homo sapiens
MTSSKIEMPGEVKADPAALMASLHLLPSPTPNLEIKYTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 36989 - protein, 497 aa, Homo sapiens
MKNQCETVWLKSPIKLKLIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 36990 - protein, 489 aa, Homo sapiens
MKGKNCNDVKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 36991 - protein, 9 aa, Homo sapiens
MDASERGRL

SEQ ID NO: 36992 - protein, 489 aa, Homo sapiens
MKGRNWKTTKIFINNEWQNSESGRVFPVYNPATGEQVCEVQEADKADIDKAVQAARLAFSLGSVWRRMDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 36993 - protein, 25 aa, Homo sapiens
MDASERGRLLDKLADLVERDRAVLA

SEQ ID NO: 36994 - protein, 422 aa, Homo sapiens
MDASERGRLLDKLADLVERDRAVLATMESLNGGKPFLQAFYVDLQGVIKTFRYYAGWADKIHGMTIPVDGDYFTFTRHEPIGVCGQIIPWNFPLLMFAWKIAPALCCGNTVVIKPAEQTPLSALYMGALIKEAGFPPGVINILPGYGPTAGAAIASHIGIDKIAFTGSTEVGKLIQEAAGRSNLKRVTLELGGKSPNIIFADADLDYAVEQAHQGVFFNQGQCCTAGSRIFVEESIYEEFVRRSVERAKRRVVGSPFDPTTEQGPQIDKKQYNKILELIQSGVAEGAKLECGGKGLGRKGFFIEPTVFSNVTDDMRIAKEEIFGPVQEILRFKTMDEVIERANNSDFGLVAAVFTNDINKALTVSSAMQAGTVWINCYNALNAQSPFGGFKMSGNGREMGEFGLREYSEVKTVTVKIPQKNS

SEQ ID NO: 36995 - protein, 85 aa, Homo sapiens
MDASERGRLLDKLADLVERDRAVLATMESLNGGKPFLQAFYVDLQGVIKTFRYYAGWADKIHGMTIPVDGDYFTFTRHEPIGVCG

SEQ ID NO: 36996 - protein, 512 aa, Homo sapiens
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 36997 - protein, 151 aa, Homo sapiens
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRLIKSSSTKS

SEQ ID NO: 36998 - protein, 517 aa, Homo sapiens [sequence omitted]

SEQ ID NO: 36999 - protein, 218 aa, Homo sapiens
MEHAVEQCHEALFFNMGQCCCAGSRTFVEESIYNEFLERTVEKAKQRKVGNPFELDTQQGPQVDKEQFERVLGYIQLGQKEGAKLLCGGERFGERGFFIKPTVFGGVQDDMRIAKEEIFGPVQPLFKFKKIEEVVERANNTRYGLAAAVFTRDLDKAMYFTQALQAGTVWVNTYNIVTCHTPFGGFKESGNGRELGEDGLKAYTEVKTVTIKVPQKNS

SEQ ID NO: 37000 - protein, 912 aa, Homo sapiens
MAGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 37001 - protein, 505 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRAPPSPSTRPDPTAT

SEQ ID NO: 37002 - protein, 902 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 37003 - protein, 160 aa, Homo sapiens
MVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMVRARLWVTCLLKATHAPVLGLRPHRKTLGSSGENGKNQTQEGTLTLICP

SEQ ID NO: 37004 - protein, 168 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFL

SEQ ID NO: 37005 - protein, 902 aa, Homo sapiens; identical to SEQ ID NO: 37002

SEQ ID NO: 37006 - protein, 157 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPD

SEQ ID NO: 37007 - protein, 177 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMV

SEQ ID NO: 37008 - protein, 100 aa, Homo sapiens
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRH

SEQ ID NO: 37009 - protein, 802 aa, Homo sapiens
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 37010 - protein, 637 aa, Homo sapiens
MGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 37011 - protein, 751 aa, Homo sapiens
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGCTVVALVPPASPAPLLLAQLAGELGPFPGILNVLSGPASLVPILASQPGIRKVAFCGAPEGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 37012 - protein, 639 aa, Homo sapiens
MRTGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 37013 - protein, 793 aa, Homo sapiens
MLSQVYRCGFQPFNQHLLPWVKCTTVFRSHCIQPSVIRHVRSWSNIPFITVPLSRTHGKSFAHRSELKHAKRIVVKLGSAVVTRGDECGLALGRLASIVEQVSVLQNQGREMMLVTSGAVAFGKQRLRHEILLSQSVRQALHSGQNQLKEMAIPVLEARACAAAGQSGLMALYEAMFTQYSICAAQILVTNLDFHDEQKRRNLNGTLHELLRMNIVPIVNTNDAVVPPAEPNSDLQGVISVKDNDSLAARLAVEMKTDLLIVLSDVEGLFDSPPGSDDAKLIDIFYPGDQQSVTFGTKSRVGMGGMEAKVKAALWALQGGTSVVIANGTHPKVSGHVITDIVEGKKVGTFFSEVKPAGPTVEQQGEMARSGGRMLATLEPEQRAEIIHHLADLLTDQRDEILLANKKDLEEAEGRLAAPLLKRLSLSTSKLNSLAIGLRQIAASSQDSVGRVLRRTRIAKNLELEQVTVPIGVLLVIFESRPDCLPQVAALAIASGNGLLLKGGKEAAHSNRILHLLTQEALSIHGVKEAVQLVNTREEVEDLCRLDKMIDLIIPRGSSQLVRDIQKAAKGIPVMGHSEGICHMYVDSEASVDKVTRLVRDSKCEYPAACNALETLLIHRDLLRTPLFDQIIDMLRVEQVKIHAGPKFASYLTFSPSEVKSLRTEYGDLELCIEVVDNVQDAIDHIHKYGSSHTDVIVTEDENTAEFFLQHVDSACVFWNASTRFSDGYRFGLGAEVGISTSRIHARGPVGLEGLLTTKWLLRGKDHVVSDFSEHGSLKYLHENLPIPQRNTN

SEQ ID NO: 37014 - protein, 795 aa, Homo sapiens [sequence omitted]

SEQ ID NO: 37015 - protein, 517 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 37016 - protein, 470 aa, Homo sapiens
MLRAAARFGPRLGRRLLSAAATQAVPAPNQQPEVFCNQIFINNEWHDAVSRKTFPTVNPSTGEVICQVAEGDKALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 37017 - protein, 453 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 37018 - protein, 511 aa, Homo sapiens
EVQRTPHPTFEYFFFLSRKLPGQELQGLNGREAGSLNTSPLGSCRSRSPSYRERLCQRRHEQDQRGREARPRRLQGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 37019 - protein, 389 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQH

SEQ ID NO: 37020 - protein, 230 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACR

SEQ ID NO: 37021 - protein, 372 aa, Homo sapiens
MSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDK

SEQ ID NO: 37022 - protein, 453 aa, Homo sapiens; identical to SEQ ID NO: 37017

SEQ ID NO: 37023 - protein, 453 aa, Homo sapiens; identical to SEQ ID NO: 37017

SEQ ID NO: 37024 - protein, 400 aa, Homo sapiens
MIQKLPEWAADEPVEKTPQTQQDELYIHSEPLGVVLVIGTWNYPFNLTIQPMVGAIAAGNSVVLKPSELSENMASLLATIIPQYLDKDLYPVINGGVPETTELLKERFDHILYTGSTGVGKIIMTAAAKHLTPVTLELGGKSPCYVDKNCDLDVACRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVIKKMIAETSSGGVAANDVIVHITLHSLPFGGVGNSGMGSYHGKKSFETFSHRRSCLVRPLMNDEGLKVRYPPSPAKMTQHWLSWPWENRSCSPSPAPLLC

SEQ ID NO: 37025 - protein, 485 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 37026 - protein, 508 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKKYQAVLRRKALLIFLVVHRLRWSSKQR

SEQ ID NO: 37027 - protein, 485 aa, Homo sapiens; identical to SEQ ID NO: 37025

SEQ ID NO: 37028 - protein, 166 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGG

SEQ ID NO: 37029 - protein, 385 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGHIINQKQFQRLRALLGCSRVAIGGQSNESDRYIAPTVLVDVQETEPVMQEEIFGPILPIVNVQSVDEAIKFINRQEKPLALYAFSNSSQVVNQMLERTSSGSFGGNEGFTYISLLSVPFGGVGHSGMGRYHGKFTFDTFSHHRTCLLAPSGLEKLKEIHYPPYTDWNQQLLRWGMGSQSCTLL

SEQ ID NO: 37030 - protein, 148 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVA

SEQ ID NO: 37031 - protein, 95 aa, Homo sapiens
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQL

SEQ ID NO: 37032 - protein, 385 aa, Homo sapiens; identical to SEQ ID NO: 37029

SEQ ID NO: 37033 - protein, 563 aa, Homo sapiens
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 37034 - protein, 195 aa, Homo sapiens
MEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMLREGVVTLPLCQMTKLRHTAVTYLARLSD

SEQ ID NO: 37035 - protein, 210 aa, Homo sapiens
MLLPAPALRRALLSRPWTGAGLRWKHTSSLKVANEPVLAFTQGSPERDALQKALKDLKGRMEAIPCVVGDEEVWTSDVQYQVSSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALM

SEQ ID NO: 37036 - protein, 563 aa, Homo sapiens; identical to SEQ ID NO: 37033

SEQ ID NO: 37037 - protein, 214 aa, Homo sapiens
MLLPAPALRRALLSRPWTGAGLRWKHTSSLKVANEPVLAFTQGSPERDALQKALKDLKGRMEAIPCVVGDEEVWTSDVQYQVSSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMVRCG

SEQ ID NO: 37038 - protein, 153 aa, Homo sapiens
NKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMLREGVVTLPLCQMTKLRHTAVTYLARLSD

SEQ ID NO: 37039 - protein, 503 aa, Homo sapiens
MEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 37040 - protein, 512 aa, Homo sapiens
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 37041 - protein, 548 aa, Homo sapiens
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAEVNQGFLLDLDPLLLASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 37042 - protein, 535 aa, Homo sapiens
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 37043 - protein, 447 aa, Homo sapiens
MVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 37044 - protein, 535 aa, Homo sapiens
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 37045 - protein, 539 aa, Homo sapiens
MWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 37046 - protein, 347 aa, Homo sapiens
MWRLPRALCVHAAKTSKLSGPWSRPAAFMSTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLFIHESIHDEVVNRLKKAYAQIRVGNPWDPNVLYGPLHTKQAVSMFLGAVEEAKKEGGTVVYGGKVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 37047 - protein, 502 aa, Homo sapiens
MGSPGRGAGLYFSSSQGLGLIPSPGLSMWRLPRALCVHAAKTSKLSGPWSRPAAFMSTLLINQPQYAWLKELGLREENEGVYNGSWGGRGEVITTYCPANNEPIARVRQASVADYEETVKKAREAWKIWADIPAPKRGEIVRQIGDALREKIQVLGSLVSLEMGKILVEGVGEVQEYVDICDYAVGLSRMIGGPILPSERSGHALIEQWNPVGLVGIITAFNFPVAVYGWNNAIAMICGNVCLWKGAPTTSLISVAVTKIIAKVLEDNKLPGAICSLTCGGADIGTAMAKDERVNLLSFTGSTQVGKQVGLMVQERFGRSLLELGGNNAIIAFEDADLSLVVPSALFAAVGTAGQRCTTARRLVMDRPGNYVEPTIVTGLGHDASIAHTETFAPILYVFKFKNEEEVFAWNNEVKQGLSSSIFTKDLGRIFRWLGPKGSDCGIVNVNIPTSGAEIGGAFGGEKHTGGGRESGSDAWKQYMRRSTCTINYSKDLPLAQGIKFQ

SEQ ID NO: 37048 - protein, 437 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 37049 - protein, 487 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQGEICLCTSRIFVQKSIYSEFLKRFVEATRKWKVGIPSDPLVSIGALISKAHLEKVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 37050 - protein, 433 aa, Homo sapiens
MAGTNALLMLENFIDGKFLPCSSYIDSYDPSTGEVYCRVPNSGKDEIEAAVKAAREAFPSWSSRSPQERSRVLNQVADLLEQSLEEFAQAESKDQGKTLALARTMDIPRSVQNFRFFASSSLHHTSECTQMDHLGCMHYTVRAPVGVAGLISPWNLPLYLLTWKIAPAMAAGNTVIAKPSELTSVTAWMLCKLLDKAGVPPGVVNIVFGTGPRVGEALVSHPEVPLISFTGSQPTAERITQLSAPHCKKLSLELGGKNPAIIFEDANLDECIPATVRSSFANQVRSYVKRALAEGAQIWCGEGVDKLSLPARNQAGYFMLPTVITDIKDESCCMTEEIFGPVTCVVPFDSEEEVIERANNVKYGLAATVWSSNVGRVHRVAKKLQSGLVWTNCWLIRELNLPFGGMKSSGIGREGAKDSYDFFTEIKTITVKH

SEQ ID NO: 37051 - protein, 518 aa, Homo sapiens
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 37052 - protein, 424 aa, Homo sapiens
MERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 37053 - protein, 1338 aa, Homo sapiens
MDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKDACQTLLKRLEPIISKNPKGTWKDWAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 37054 - protein, 151 aa, Homo sapiens
MLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKEN

SEQ ID NO: 37055 - protein, 285 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 37056 - protein, 290 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQVARSS

SEQ ID NO: 37057 - protein, 325 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPY

SEQ ID NO: 37058 - protein, 325 aa, Homo sapiens; identical to SEQ ID NO: 37057

SEQ ID NO: 37059 - protein, 147 aa, Homo sapiens
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKAL

SEQ ID NO: 37060 - protein, 316 aa, Homo sapiens
MASRLLLNNGAKMPILGLGTWKSPPGQVTEAVKVAIDVGYRHIDCAHVYQNENEVGVAIQEKLREQVVKREELFIVSKLWCTYHEKGLVKGACQKTLSDLKLDYLDLYLIHWPTGFKPGKEFFPLDESGNVVPSDTNILDTWAAMEELVDEGLVKAIGISNFNHLQVEMILNKPGLKYKPAVNQIECHPYLTQEKLIQYCQSKGIVVTAYSPLGSPDRPWAKPEDPSLLEDPRIKAIAAKHNKTTAQVLIRFPMQRNLVVIPKSVTPERIAENFKVFDFELSSQDMTTLLSYNRNWRVCALLSCTSHKDYPFHEEF

SEQ ID NO: 37061 - protein, 205 aa, Homo sapiens
MGVVSLFLCIVEQIFTSSKKIQFRGIFMAKVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQPRDNSIFSLSPDW

SEQ ID NO: 37062 - protein, 323 aa, Homo sapiens
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 37063 - protein, 323 aa, Homo sapiens; identical to SEQ ID NO: 37062

SEQ ID NO: 37064 - protein, 248 aa, Homo sapiens
  MOD_RES (1)..(1): Any amino acid
XSKYQCVKLNDGHFMPVLGFGTYAPAEVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNV

SEQ ID NO: 37065 - protein, 323 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 37066 - protein, 323 aa, Homo sapiens; identical to SEQ ID NO: 37065

SEQ ID NO: 37067 - protein, 297 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 37068 - protein, 139 aa, Homo sapiens
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKEDIGILTWKKSPKHNS

SEQ ID NO: 37069 - protein, 323 aa, Homo sapiens
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 37070 - protein, 204 aa, Homo sapiens
MSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 37071 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 37072 - protein, 323 aa, Homo sapiens; identical to SEQ ID NO: 37071

SEQ ID NO: 37073 - protein, 126 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKSTT

SEQ ID NO: 37074 - protein, 326 aa, Homo sapiens
MDLSAASHRIPLSDGNSIPIIGLGTYSEPKSTPKGACATSVKVAIDTGYRHIDGAYIYQNEHEVGEAIREKIAEGKVRREDIFYCGKLWATNHVPEMVRPTLERTLRVLQLDYVDLYIIEVPMAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWVNVSSPPLLKDALLNSLGKRYNKTAAQIVLRFNIQRGVVVIPKSFNLERIKENFQIFDFSLTEEEMKDIEALNKNVRFVELLMWRDHPEYPFHDEY

SEQ ID NO: 37075 - protein, 146 aa, Homo sapiens
MAFKPGDEIYPRDENGKWLYHKSNLCATWEAMEACKDAGLVKSLGVSNFNRRQLELILNKPGLKHKPVSNQVECHPYFTQPKLLKFCQQHDIVITAYSPLGTSRNPIWRQLHKLALLDLPILRVTLHSVHTLHSEKLVTGDLQCPG

SEQ ID NO: 37076 - protein, 223 aa, Homo sapiens
MAHRFPALTQEQKKDSQGKLFRNILKEKGIVVGIKLDQGGAPLAGTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAIPTRVQCPPA

SEQ ID NO: 37077 - protein, 364 aa, Homo sapiens
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 37078 - protein, 316 aa, Homo sapiens
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSGVARLQTRRQPRRLL

SEQ ID NO: 37079 - protein, 364 aa, Homo sapiens
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 37080 - protein, 364 aa, Homo sapiens; identical to SEQ ID NO: 37079

SEQ ID NO: 37081 - protein, 149 aa, Homo sapiens
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWR

SEQ ID NO: 37082 - protein, 264 aa, Homo sapiens
MPSIFAYQSSEVDWCESNFQYSELVAEFYNTFSNIPFFIFGPLMMLLMHPYAQKRSRYIYVVWVLFMIIGLFSMYFHMTLSFLGQLLDEIAILWLLGSGYSIWMPRCYFPSFLGGNRSQFIRLVFITTVVSTLLSFLRPTVNAYALNSIALHILYIVCQEYRKTSNKELRHLIEVSVVLWAVALTSWISDRLLCSFWQRIHFFYLHSIWHVLISITFPYGMVTMALVDANYEMPGETLKVRYWPRDSWPVGLPYVEIRGDDKDC

SEQ ID NO: 37083 - protein, 275 aa, Homo sapiens [sequence omitted]

SEQ ID NO: 37084 - protein, 140 aa, Homo sapiens
MCLFRQYATCFNSGIYLIWTLLVVVGIGSVYFHATLSFLGQMLDELAVLWVLMCALAMWFPRRYLPKIFRNDRGRFKVVVSVLSAVTTCLAFVKPAINNISLMTLGVPCTALLIAELKRHERNQRRRHRKGGQQGGGDKV

SEQ ID NO: 37085 - protein, 528 aa, Homo sapiens
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 37086 - protein, 170 aa, Homo sapiens [sequence omitted]

SEQ ID NO: 37087 - protein, 170 aa, Homo sapiens [sequence omitted]

SEQ ID NO: 37088 - protein, 524 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 37089 - protein, 524 aa, Homo sapiens; identical to SEQ ID NO: 37088

SEQ ID NO: 37090 - protein, 524 aa, Homo sapiens; identical to SEQ ID NO: 37088

SEQ ID NO: 37091 - protein, 447 aa, Homo sapiens
MPWSFRSSTPTWLRMSSCSWEMTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 37092 - protein, 469 aa, Homo sapiens
MFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 37093 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 37094 - protein, 532 aa, Homo sapiens
MQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 37095 - protein, 157 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGIKMAVTTSGSTEMMKENWPLGAPLPLSPSVPAETLSSGIRIPVGKAPPGGWRWSGCRWPTGAY

SEQ ID NO: 37096 - protein, 389 aa, Homo sapiens
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLWEQSKEFLRYKEATKRRPRSLLEKLRWVTVGYHYNWDSKKYSADHYTPFPSDLGFLSEQVAAACGFEDFRAEAGILNYYRLDSTLGIHVDRSELDHSKPLLSFSFGQSAIFLLGGLQRDEAPTAMFMHSGDIMIMSGFSRLLNHAVPRVLPNPEGEGLPHCLEAPLPAVLPRDSMVEPCSMEDWQVCASYLKTARVNMTVRQVLATDQNFPLEPIEDEKRDISTEGFCHLDDQNSEVKRARINPDS

SEQ ID NO: 37097 - protein, 261 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTGQTFNFVLINRYKDGCDHIGEHRDDERELAPGSPIASVSFGACRDFVFRHKDSRGKSPSRRVAVVRLPLAHGSLLMMNHPTNTHWYHSLPVRKKVLAPRVNLTFRKILLTKK

SEQ ID NO: 37098 - protein, 261 aa, Homo sapiens; identical to SEQ ID NO: 37097

SEQ ID NO: 37099 - protein, 261 aa, Homo sapiens; identical to SEQ ID NO: 37097

SEQ ID NO: 37100 - protein, 150 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTG

SEQ ID NO: 37101 - protein, 121 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLT

SEQ ID NO: 37102 - protein, 160 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTGQTFNFVLINR

SEQ ID NO: 37103 - protein, 286 aa, Homo sapiens
MEEKRRRARVQGAWAAPVKSQAIAQPATTAKSHLHQKPGQTWKNKEHHLSDREFVFKEPQQVVRRAPEPRVIDREGVYEISLSPTGVSRVCLYPGFVDVKEADWILEQLCQDVPWKQRTGIREDITYQQPRLTAWYGELPYTYSRITMEPNPHWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 37104 - protein, 170 aa, Homo sapiens
MEEKRRRARVQGAWAAPVKSQAIAQPATTAKSHLHQKPGQTWKNKEHHLSDREFVFKEPQQVVRRAPEPRVIEEGVYEISLSPTGVSRVCLYPGFVDVKEADWILEQLCQDVPWKQRTGIREDSILQLTFKKSAPVSGTATAPQSCWYERPSPPHIPGPAILTRTRLWAP

SEQ ID NO: 37105 - protein, 60 aa, Homo sapiens
MEEKRRRARVQGAWAAPVKSQAIAQPATTAKSHLHQKPGQTWKNKEHHLSDREFVFKEPQ

SEQ ID NO: 37106 - protein, 302 aa, Homo sapiens
MAAAAAETPEVLRECGCKGIRTCLICERQRGSDPPWELPPAKTYRFIYCSDTGWAVGTEESDFEGWAFPFPGVMLIEDFVTREEEAELVRLMDRDPWKLSQSGRRKQDYGPKVNFRKQKLKTEGFCGLPSFSREVVRRMGLYPGLEGFRPVEQCNLDYCPERGSAIDPHLDDAWLWGERLVSLNLLSPTVLSMCREAPGSLLLCSAPSAAPEALVDSVIAPSRSVLCQEVEVAIPLPARSLLVLTGAARHQWKHAIHRRHIEARRVCVTFRELSAEFGPGGRQQELGQELLRIALSFQGRPV

SEQ ID NO: 37107 - protein, 458 aa, Homo sapiens
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPGNSGSSLRSCPSFCFEGFVFVHWGVFVFCFLFFLILYIFPWFCCLLGLKNRIGQDLGSHILGIPPGWKGCWHQ

SEQ ID NO: 37108 - protein, 394 aa, Homo sapiens
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 37109 - protein, 383 aa, Homo sapiens
MRRCRRPCPAGRGEGGGGRSPAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 37110 - protein, 238 aa, Homo sapiens
MEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 37111 - protein, 266 aa, Homo sapiens
MAGRGMGMLNLEIGGDAGGRIGCKELVLMEEQDARVPALEPFRVEQAPPVIYYVPDFISKEEEEYLLRQVFNAPKPKWTQLSGRKLQNWGGLPHPRGMVPERLPPWLQRYVDKVSNLSLFGGLPANHVLVNQYLPGEGIMPHEDGPLYYPTVSTISLGSHTVLDFYEPRRPEDDDPTEQPRPPPRPTTSLLLEPRSLLVLRGPAYTRLLHGIAAARVDALDAASSPPNAAACPSARPGACLVRGTRVSLTIRRVPRVLRAGLLLGK

SEQ ID NO: 37112 - protein, 238 aa, Homo sapiens; identical to SEQ ID NO: 37110

SEQ ID NO: 37113 - protein, 221 aa, Homo sapiens
MAGTGLLALRTLPGPSWVRGSGPSVLSRLQDAAVVRPGFLSTAEEETLSRELEPELRRRRYEYDHWDAAIHGFRETEKSRWSEASRAILQRVQAAAFGPGQTLLSSVHVLDLEARGYIKPHVDSIKFCGATIAGLSLLSPSVMRLVHTQEPGEWLELLLEPGSLYILRGSARYDFSHEILRDEESFFGERRIPRGRRISVICRSLPEGMGPGESGQPPPAC

SEQ ID NO: 37114 - protein, 664 aa, Homo sapiens
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKGYIKHKPDQMTINQYEPGQGIPAHIDTHSAFEDEIVSLSLGSEIVMDFKHPDGIAVPVMLPRRSLLVMTGESRYLWTHGITCRKFDTVQASESLKSGIITSDVGDLTLSKRGLRTSFTFRKVRQTPCNCSYPLVCDSQRKETPPSFPESDKEASRLEQEYVHQVYEEIAGHFSSTRHTPWPHIVEFLKALPSGSIVADIGCGNGKYLGINKELYMIGCDRSQNLVDICRERQFQAFVCDALAVPVRSGSCDACISIAVIHHFATAERRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 37115 - protein, 667 aa, Homo sapiens
MFAMDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKGYIKHKPDQMTINQYEPGQGIPAHIDTHSAFEDEIVSLSLGSEIVMDFKHPDGIAVPVMLPRRSLLVMTGESRYLWTHGITCRKFDTVQASESLKSGIITSDVGDLTLSKRGLRTSFTFRKVRQTPCNCSYPLVCDSQRKETPPSFPESDKEASRLEQEYVHQVYEEIAGHFSSTRHTPWPHIVEFLKALPSGSIVADIGCGNGKYLGINKELYMIGCDRSQNLVDICRERQFQAFVCDALAVPVRSGSCDACISIAVIHHFATAERRVAALQEIVRLLRPGGKALIYVWAMEQEYNKQKSKYLRGNRNSQGKKEEMNSDTSVQRSLVEQMRDMGSRDSASSVPRINDSQEGGCNSRQVSNSKLPVHVNRTSFYSQDVLVPWHLKGNPDKGKPVEPFGPIGSQDPSPVFHRYYHVFREGELEGACRTVSDVRILQSYYDQGNWCVILQKA

SEQ ID NO: 37116 - protein, 664 aa, Homo sapiens; identical to SEQ ID NO: 37114

SEQ ID NO: 37117 - protein, 224 aa, Homo sapiens
MDSNHQSNYKLSKTEKKFLRKQIKAKHTLLRHEGIETVSYATQSLVVANGGLGNGVSRNQLLPVLEKCGLVDALLMPPNKPYSFARYRTTEESKRAYVTLNGKEVVDDLGQKITLYLNFVEKVQWKELRPQALPPGLMVVEEIISSEEEKMLLESVDWTEDTDNQNSQKSLKHRRVKHFGYEFHYENNNVDKDKPLSGGLPDICESFLEKWLRKAEKNLEVGIH

SEQ ID NO: 37118 - protein, 445 aa, Homo sapiens
MKNPEAQQDVSVSQGFRMLFYTMKPSETSFQTLEEVPDYVKKATPFFISLMLLELVVSWILKGKPPGRLDDALTSISAGVLSRLPSLFFRSIELTSYIYIWENYRLFNLPWDSPWTWYSAFLGVDFGYYWFHRMAHEVNIMWAGHQTHHSSEDYNLSTALRQSVLQIYTSWIFYSPLALFIPPSVYAVHLQFNLLYQFWIHTEVINNLGPLELILNTPSHHRVHHGRNRYCIDKNYAGVLIIWDKIFGTFEAENEKVVYGLTHPINTFEPIKVQFHHLFSIWTTFWATPGFFNKFSVIFKGPGWGPGKPRLGLSEEIPEVTGKEVPFSSSSSQLLKIYTVVQFALMLAFYEETFADTAALSQVTLLLRVCFIILTLTSIGFLLDQRPKAAIMETLRCLMFLMLYRFGHLKPLVPSLSSAFEIVFSICIAFWGVRSMKQLTSHPWK

SEQ ID NO: 37119 - protein, 658 aa, Homo sapiens
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 37120 - protein, 321 aa, Homo sapiens
MDPKYPWSKCGHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFY

SEQ ID NO: 37121 - protein, 391 aa, Homo sapiens
MDMASESVGGKILFATDDFFAPAENLIKSDSPCFKEHEYTEFGKWMDGWETRRKRIPGHDWCVLRLGIQGVIRGFDVDVSYFTGDYAPRVSIQAANLEEDKLPEIPERGTRTGAAATPEEFEAIAELKSDDWSYLVPMTELKPGNPASGHNYFLVNSQQRWTHIRLNIFPDGGIARLRVFGTGQKDWTATDPKEPADLVAIAFGGVCVGFSNAKFGHPNNIIGVGGAKSMADGWETARRLDRPPILENDENGILLVPGCEWAVFRLAHPGVITRIEIDTKYFEGNAPDSCKVDGCILTTQEEEAVIRQKWILPAHKWKPLLPVTKLSPNQSHLFDSLTLELQDVITHARLTIVPDGGVSRLRLRGFPSSICLLRPREKPMLKFSVSFKANP

SEQ ID NO: 37122 - protein, 161 aa, Homo sapiens
GRKASEKTGGREGEPADRGLQLGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 37123 - protein, 93 aa, Homo sapiens
MEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 37124 - protein, 147 aa, Homo sapiens
MSQTRDLQGGKAFGLLKAQQEERLDEINKQFLDDPKYSSDEDLPSKLEGFKEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 37125 - protein, 93 aa, Homo sapiens; identical to SEQ ID NO: 37123

SEQ ID NO: 37126 - protein, 147 aa, Homo sapiens; identical to SEQ ID NO: 37124

SEQ ID NO: 37127 - protein, 161 aa, Homo sapiens; identical to SEQ ID NO: 37122

SEQ ID NO: 37128 - protein, 147 aa, Homo sapiens; identical to SEQ ID NO: 37124

SEQ ID NO: 37129 - protein, 147 aa, Homo sapiens; identical to SEQ ID NO: 37124

SEQ ID NO: 37130 - protein, 93 aa, Homo sapiens; identical to SEQ ID NO: 37123

SEQ ID NO: 37131 - protein, 93 aa, Homo sapiens; identical to SEQ ID NO: 37123

SEQ ID NO: 37132 - protein, 161 aa, Homo sapiens; identical to SEQ ID NO: 37122

SEQ ID NO: 37133 - protein, 93 aa, Homo sapiens; identical to SEQ ID NO: 37123

SEQ ID NO: 37134 - protein, 93 aa, Homo sapiens; identical to SEQ ID NO: 37123

SEQ ID NO: 37135 - protein, 147 aa, Homo sapiens; identical to SEQ ID NO: 37124

SEQ ID NO: 37136 - protein, 161 aa, Homo sapiens; identical to SEQ ID NO: 37122

SEQ ID NO: 37137 - protein, 147 aa, Homo sapiens; identical to SEQ ID NO: 37124

SEQ ID NO: 37138 - protein, 161 aa, Homo sapiens; identical to SEQ ID NO: 37122

SEQ ID NO: 37139 - protein, 161 aa, Homo sapiens; identical to SEQ ID NO: 37122

SEQ ID NO: 37140 - protein, 93 aa, Homo sapiens; identical to SEQ ID NO: 37123

SEQ ID NO: 37141 - protein, 353 aa, Homo sapiens
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTRFEATSRALLAQLHARYCPTTHEAMKMYL

SEQ ID NO: 37142 - protein, 353 aa, Homo sapiens; identical to SEQ ID NO: 37141

SEQ ID NO: 37143 - protein, 353 aa, Homo sapiens; identical to SEQ ID NO: 37141

SEQ ID NO: 37144 - protein, 436 aa, Homo sapiens
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTAGPAACPLLPHDARGHENVLVRGPPGHLPNLLLMGHWAALPGEARLRAREREARAATGLRQAVEELWEQAQWEAVDTPRTVSCLEAGLTHGAIASGGRSVSAPGLLDNRQEG

SEQ ID NO: 37145 - protein, 102 aa, Homo sapiens
MALLKANKDLISAGLKEFSVLLNQQVFNDPLVSEEDMVTVVEDWMNFYINYYRQQVTGEPQERDKALQELRQELNTLANPFLAKYRDFLKSHELPSHPPPSS

SEQ ID NO: 37146 - protein, 495 aa, Homo sapiens
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 37147 - protein, 352 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 37148 - protein, 270 aa, Homo sapiens
MDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVGECGSPPLCALHPQDPVPPVNHLRIEKVANRGHSSGRTPGGFLKS

SEQ ID NO: 37149 - protein, 298 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 37150 - protein, 367 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 37151 - protein, 433 aa, Homo sapiens
MFAGCFFFLLNQSRNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 37152 - protein, 1474 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 37153 - protein, 168 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQ

SEQ ID NO: 37154 - protein, 1489 aa, Homo sapiens
RVQYVCSPPAPSFCNMGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 37155 - protein, 1454 aa, Homo sapiens
MWAQLLLGMLALSPAIAEELPNYLVTLPARLNFPSVQKVCLDLSPGYSDVKFTVTLETKDKTQKLLEYSGLKKRHLHCISFLVPPPAGGTEEVATIRVSGVGNNISFEEKKKVLIQRQGNGTFVQTDKPLYTPGQQVYFRIVTMDSNFVPVNDKYSMVELQDPNSNRIAQWLEVVPEQGIVDLSFQLAPEAMLGTYTVAVAEGKTFGTFSVEEYVLPKFKVEVVEPKELSTVQESFLVKICCRYTYGKPMLGAVQVSVCQKANTYWYREVEREQLPDKCRNLSGQTDKTGCFSAPVDMATFDLIGYAYSHQINIVATVVEEGTGVEANATQNIYISPQMGSMTFEDTSNFYHPNFPFSGKIRVRGHDDSFLKNHLVFLVIYGTNGTFNQTLVTDNNGLAPFTLETSGWNGTDVSLEGKFQMEDLVYNPEQVPRYYQNAYLHLRPFYSTTRSFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 37156 - protein, 1454 aa, Homo sapiens
MWAQLLLGMLALSPAIAEELPNYLVTLPARLNFPSVQKVCLDLSPGYSDVKFTVTLETKDKTQKLLEYSGLKKRHLHCISFLVPPPAGGTEEVATIRVSGVGNNISFEEKKKVLIQRQGNGTFVQTDKPLYTPGQQVYFRIVTMDSNFVPVNDKVSWEEGQDPNSNRIAQWLEVVPEQGIVDLSFQLAPEAMLGTYTVAVAEGKTFGTFSVEEYVLPKFKVEVVEPKELSTVQESFLVKICCRYTYGKPMLGAVQVSVCQKANTYWYREVEREQLPDKCRNLSGQTDKTGCFSAPVDMATFDLIGYAYSHQINIVATVVEEGTGVEANATQNIYISPQMGSMTFEDTSNFYHPNFPFSGKIRVRGHDDSFLKNHLVFLVIYGTNGTFNQTLVTDNNGLAPFTLETSGWNGTDVSLEGKFQMEDLVYNPEQVPRYYQNAYLHLRPFYSTTRSFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 37157 - protein, 1004 aa, Homo sapiens
SFLGIHRLNGPLKCGQPQEVLVDYYIDPADASPDQEISFSYYLIGKGSLVMEGQKHLNSKKKGLKASFSLSLTFTSRLAPDPSLVIYAIFPSGGVVADKIQFSVEMCFDNQVSLGFSPSQQLPGAEVELQLQAAPGSLCALRAVDESVLLLRPDRELSNRSVYGMFPFWYGHYPYQVAEYDQCPVSGPWDFPQPLIDPMPQGHSSQRSIIWRPSFSEGTDLFSFFRDVGLKILSNAKIKKPVDCSHRSPEYSTAMGAGGGHPEAFESSTPLHQAEDSQVRQYFPETWLWDLFPIGNSGKEAVHVTVPDAITEWKAMSFCTSQSRGFGLSPTVGLTAFKPFFVDLTLPYSVVRGESFRLTATIFNYLKDCIRVQTDLAKSHEYQLESWADSQTSSCLCADDAKTHHWNITAVKLGHINFTISTKILDSNEPCGGQKGFVPQKGRSDTLIKPVLVKPEGVLVEKTHSSLLCPKGKVASESVSLELPVDIVPDSTKAYVTVLGDIMGTALQNLDGLVQMPSGCGEQNMVLFAPIIYVLQYLEKAGLLTEEIRSRAVGFLEIGYQKELMYKHSNGSYSAFGERDGNGNTWLTAFVTKCFGQAQKFIFIDPKNIQDALKWMAGNQLPSGCYANVGNLLHTAMKGGVDDEVSLTAYVTAALLEMGKDVDDPMVSQGLRCLKNSATSTTNLYTQALLAYIFSLAGEMDIRNILLKQLDQQAIISGESIYWSQKPTPSSNASPWSEPAAVDVELTAYALLAQLTKPSLTQKEIAKATSIVAWLAKQHNAYGGFSSTQDTVVALQALAKYATTAYMPSEEINLVVKSTENFQRTFNIQSVNRLVFQQDTLPNVPGMYTLEASGQGCVYVQTVLRYNILPPTNMKTFSLSVEIGKARCEQPTSPRSLTLTIHTSYVGSRSSSNMAIVEVKMLSGFSPMEGTNQLLLQQPLVKKVEFGTDTLNIYLDELIKNTQTYTFTISQSVLVTNLKPATIKVYDYYLPDEQATIQYSDPCE

SEQ ID NO: 37158 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 37159 - protein, 1244 aa, Homo sapiens
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNGEGAVFNKSLSGSQTSSAWSNLSGFSSSASWEEVNYHVDDRSARKEPGKEHLVDTQCSTALSEELENDREGRAMHSLHSQLHDLSLQEPNNDNLEPSQNQPQQQMPLTPFSPHNTPGIFLAPGAGLLEGAPEGIQEVRNMGPRNTSAHSRPSYRSASWSSDSGRPKNMGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 37160 - protein, 142 aa, Homo sapiens
MNNQKVVAVLLQECKALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGSHPAKHSM

SEQ ID NO: 37161 - protein, 1244 aa, Homo sapiens; identical to SEQ ID NO: 37159

SEQ ID NO: 37162 - protein, 1166 aa, Homo sapiens
MCRKRTRARTSAAEASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNGEGAVFNKSLSGSQTSSAWSNLSGFSSSASWEEVNYHVDDRSARKEPGKEHLVDTQCSTALSEELENDREGRAMHSLHSQLHDLSLQEPNNDNLEPSQNQPQQQMPLTPFSPHNTPGIFLAPGAGLLEGAPEGIQEVRNMGPRNTSAHSRPSYRSASWSSDSGRPKNMGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 37163 - protein, 382 aa, Homo sapiens
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 37164 - protein, 198 aa, Homo sapiens
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRTWTKV

SEQ ID NO: 37165 - protein, 229 aa, Homo sapiens
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRSLIPYFNLYLQFLNISMQNLFKVHTLLRPCYFLGQK

SEQ ID NO: 37166 - protein, 394 aa, Homo sapiens
MALQGISVVELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEGTAYLSSFLWKTQKLSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKAGSKFWILYPTHSNIQK

SEQ ID NO: 37167 - protein, 333 aa, Homo sapiens
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYPLFVTWKIGRDKRLRGCIGTFSAMNLHSGLREYTLTSALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 37168 - protein, 210 aa, Homo sapiens
MVVSAEMCCFCFDVLYCHLYGYQQPRTPRFTNEPYPLFVTWKIGRDKRLRGCIGTFSAMNLHSGLREYTLTSALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 37169 - protein, 296 aa, Homo sapiens
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 37170 - protein, 953 aa, Homo sapiens
MCNPEEAALLRLEEVFSATLAHVNSLVLQPLLPAAPDPSDPWGRECLRLLQQLHKSSQQLWEVTEESLHSLQERLRYPDSTGLESLLLLRGADRVLQAHIEYIESYTSCMVVQAFQKAAKRRSEYWRGQRKALRQLLSGVSSEGSVGASLGQALHQPLAHHVQQYVLLLLSLGDTIGEHHPTRELVVNAVTLFGNLQSFMKQELDQAVATQALWHTLRGRLRDVLCTPAHRLLQDSQDVPVTVAPLRAERVLLFDDALVLLQGHNVHTFDLKLVWVDPGQDGCTFHLLTPEEEFSFCAKDSQGQAVWQWKVTWAVHQALHGKKDFPVLGAGLEPSQPPDCRCAEYTFQAEGRLCQATYEGEWCRGRPHGKGTLKWPDGRNHVGNFCQGLEHGFGIRLLPQASEDKFDCYKCHWREGSMCGYGICEYSTDEVYKGYFQEGLRHGFGVLESGPQAPQPFRYTGHWERGQRSGYGIEEDGDRGERYIGMWQAGQRHGPGVMVTQAGVCYQGTFQADKTVGPGILLSEDDSLYEGTFTRDLTLMGKGKVTFPNGFTLEGSFGSGAGRGLHTQGVLDTAALPPDPSSTCKRQLGVGAFPVESRWQGVYSPFRDFVCAGCPRDLQEALLGFDVQSSRELRRSQDYLSCERTHPEDSVGSMEDILEELLQHREPKALQLYLRKALSNSLHPLGKLLRTLMLTFQATYAGVGANKHLQELAQEEVKQHAQELWAAYRGLLRVALERKGQALEEDEDTETRDLQVHGLVLPLMLPSFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 37171 - protein, 300 aa, Homo sapiens
MEDILEELLQHREPKALQLYLRKALSNSLHPLGKLLRTLMLTFQATYAGVGANKHLQELAQEEVKQHAQELWAAYRGLLRVALERKGQALEEDEDTETRDLQVHGLVLPLMLPSFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 37172 - protein, 953 aa, Homo sapiens; identical to SEQ ID NO: 37170

SEQ ID NO: 37173 - protein, 4167 aa, Homo sapiens
MEPEDLPWPGELEEEEEEEEEEEEEEEEAAAAAAANVDDVVVVEEVEEEAGRELDSDSHYGPQHLESIDDEEDEEAKAWLQAHPGRILPPLSPPQHRYSEGERTSLEKIVPLTCHVWQQIVYQGNSRTQISDTNVVCLETTAQRGSGDDQKTESWHCLPQEMDSSQTLDTSQTRFNVRTEDTEVTDFPSLEEGILTQSENQVKEPNRDLFCSPLLVIQDSFASPDLPLLTCLTQDQEFAPDSLFHQSELSFAPLRGIPDKSEDTEWSSRPSEVSEALFQATAEVASDLASSRFSVSQHPLIGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTKGLQGKVESDVITLDGLNENAVVCSERVAELQRKPTRESEYHSSDLRMLRMSPDTVPKAPKHLKAGDTSKGGIAKVTQSNLKSGITTTPVDSDIGSHLSLSLEDLSQLAVSSLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHVEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLEENSDVTSWSEEKREEKMLFTGYPEDRKLKKNKKNSHEGVSWFVPVENVESRSKKENVPNTCGPGISWFEPITKTRPWREPLREQNCQGQHLDGRGYLAGPGREAGRDLLRPFVRATLQESLQFHRPDFISRSGERIKRLKLIVQERKLQSMLQTERDALFNIDRERQGHQNRMCPLPKRVFLAIQKNKPISKKEMIQRSKRIYEQLPEVQKKREEEKRKSEYKSYRLRAQLYKKRVTNQLLGRKVPWD

SEQ ID NO: 37174 - protein, 2561 aa, Homo sapiens
MEPEDLPWPGELEEEEEEEEEEEEEEEEAAAAAAANVDDVVVVEEVEEEAGRELDSDSHYGPQHLESIDDEEDEEAKAWLQAHPGRILPPLSPPQHRYSEGERTSLEKIVPLTCHVWQQIVYQGNSRTQISDTNVVCLETTAQRGSGDDQKTESWHCLPQEMDSSQTLDTSQTRFNVRTEDTEVTDFPSLEEGILTQSENQVKEPNRDLFCSPLLVIQDSFASPDLPLLTCLTQDQEFAPDSLFHQSELSFAPLRGIPDKSEDTEWSSRPSEVSEALFQATAEVASDLASSRFSVSQHPLIGSTAVGSQCPFLPSEQGNNEETISSVDELKIPKDCDRYDDLCSYMSWKTRKDTQWPENNLADKDQVSVATSFDITDENIATKRSDHFDAARSYGQYWTQEDSSKQAETYLTKGLQGKVESDVITLDGLNENAVVCSERVAELQRKPTRESEYHSSDLRMLRMSPDTVPKAPKHLKAGDTSKGGIAKVTQSNLKSGITTTPVDSDIGSHLSLSLEDLSQLAVSSLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHVEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQS

SEQ ID NO: 37175 - protein, 647 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQPQLGDRVAPFTLGPSLKRCLGPEQRTRLPVVGDGGDVDSGRLLFWGPSRGRASPSTGQPPCHPVCRPSSPPSPRPSSGDPSRVKAGHKHVGTGRANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 37176 - protein, 553 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 37177 - protein, 349 aa, Homo sapiens
MVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKRRSLSLSPRLESVVPSQLTASSASRVQVVLLPQPPK

SEQ ID NO: 37178 - protein, 326 aa, Homo sapiens
MEFLSEKFALKSPPSKNSDFYMGAGGPLEHVMETLDNESFYSKASAGKCVQAFGPLPRAEHHVRLERTSPCQDSSVNYGITKVEGQPLHTELNRAMDNCNSLRMSPVKGMQEKGELDELGDKCDSNVSSSKKRRHRTTFTSLQLEELEKVFQKTHYPDVYVREQLALRTELTEARVQVWFQNRRAKWRKRERYGQIQQAKSHFAATYDISVLPRTDSYPQIQNNLWAGNASGGSVVTSCMLPRDTSSCMTPYSHSPRTDSSYTGFSNHQNQFSHVPLNNFFTDSLLTGATNGHAFETKPEFERRSSSIAVLRMKAKEHTANISWAM

SEQ ID NO: 37179 - protein, 343 aa, Homo sapiens
MDPEHCAPFRVGPAPGPYVASGDEPPGPQGTPAAAPHLHPAPPRGPRLTRFPACGPLEPYLPEPAKPPAKYLQDLGPGPALNGGHFYEGPAEAEEKTSKAASFPQLPLDCRGGPRDGPSNLQGSPGPCLASLHLPLSPGLPDSMELAKNKSKKRRNRTTFSTFQLEELEKVFQKTHYPDVYAREQLALRTDLTEARVQVWFQNRRAKWRKRERYGKIQEGRNPFTAAYDISVLPRTDSHPQLQNSLWASPGSGSPGGPCLVSPEGIPSPCMSPYSHPHGSVAGFMGVPAPSAAHPGIYSIHGFPPTLGGHSFEPSSDGDYKSPSLVSLRVKPKEPPGLLNWTT

SEQ ID NO: 37180 - protein, 411 aa, Homo sapiens
MNAETCVSYCESPAAAMDAYYSPVSQSREGSSPFRAFPGGDKFGTTFLSAAAKAQGFGDAKSRARYGAGQQDLATPLESGAGARGSFNKFQPQPSTPQPQPPPQPQPQQQQPQPQPPAQPHLYLQRGACKTPPDGSLKLQEGSSGHSAALQVPCYAKESSLGEPELPPDSDTVGMDSSYLSVKEAGVKGPQDRASSDLPSPLEKADSESNKGKKRRNRTTFTSYQLEELEKVFQKTHYPDVYAREQLAMRTDLTEARVQVWFQNRRAKWRKRERFGQMQQVRTHFSTAYELPLLTRAENYAQIQNPSWLGNNGAASPVPACVVPCDPVPACMSPHAHPPGSGASSVTDFLSVSGAGSHVGQTHMGSLFGAASLSPGLNGYELNGEPDRKTSSIAALRMKAKEHSAAISWAT

SEQ ID NO: 37181 - protein, 209 aa, Homo sapiens
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 37182 - protein, 208 aa, Homo sapiens
MRSTILLFCLLGSTRSLPLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 37183 - protein, 751 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 37184 - protein, 770 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARTEGGQPRALSQAASPVPGRYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 37185 - protein, 627 aa, Homo sapiens
MRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 37186 - protein, 249 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEEL

SEQ ID NO: 37187 - protein, 751 aa, Homo sapiens; identical to SEQ ID NO: 37183

SEQ ID NO: 37188 - protein, 337 aa, Homo sapiens
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVL

SEQ ID NO: 37189 - protein, 193 aa, Homo sapiens
MEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPWSLSSFFTTTRTLKMRTWWPG

SEQ ID NO: 37190 - protein, 751 aa, Homo sapiens; identical to SEQ ID NO: 37183

SEQ ID NO: 37191 - protein, 563 aa, Homo sapiens
MSRIGGAGLPAAALTGPGRFRMAREEPAPAALAAAGQPGGGRGGERALQGPGVARRGRPSLSRAKLHGLRHMCAGRTAAGGSFQRRALWVLAFCTSFGLLLSWSSNRLLYWLSFPSHTRVHREWSRQLPFPAVTVCNNNPLRFPRLSKGDLYYAGHWLGLLLPNRTARPLVSELLRGDEPRRQWFRKLADFRLFLPPRHFEGISAAFMDRLGHQLEDMLLSCKYRGELCGPHNFSSVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 37192 - protein, 512 aa, Homo sapiens
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 37193 - protein, 203 aa, Homo sapiens
MFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKY

SEQ ID NO: 37194 - protein, 574 aa, Homo sapiens
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGELLMTPVPFSCHGHGVAPYHPKAGCSLLSHEGPPPQRPFPKPCCLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 37195 - protein, 528 aa, Homo sapiens
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 37196 - protein, 562 aa, Homo sapiens
MPIQIFCSMSFSSGEEAPGPLGDIWGPHHHQQQQDISESEEEEEEKEKEAVRKEASEGHSPMDLVAFANSCTLHGTNHIFVEGGPGPRQVLWAVAFVLALGAFLCQVGDRVAYYLSYPHVTLLNEVATTELAFPAVTLCNTNAVRLSQLSYPDLLYLAPMLGLDESDDPGVPLAPPGPEAFSGEPFNLHRFYNRSCHRLEDMLLYCSYQGGPCGPHNFSVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 37197 - protein, 549 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPSTLLCSEDLPPLPVPSPRLSPPPTAPATLSHSSRPAVCVLGAPP

SEQ ID NO: 37198 - protein, 531 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPRPPTPPCAVTKTLSASHRTCYLVTQL

SEQ ID NO: 37199 - protein, 543 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLTSHPSLCRHQDSLRLPPHLLPCHTALDLLSVSSEPRPDILDMPSLHVAFPSSPQIKS

SEQ ID NO: 37200 - protein, 647 aa, Homo sapiens
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 37201 - protein, 666 aa, Homo sapiens
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 37202 - protein, 756 aa, Homo sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYRIQIHSPLGIHIPLESDMERALSWGRYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 37203 - protein, 729 aa, Homo sapiens
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 37204 - protein, 763 aa, Homo sapiens
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 37205 - protein, 312 aa, Homo sapiens
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 37206 - protein, 336 aa, Homo sapiens
MLPAVAVSEPVVLRFMIFCRLLAKMANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPIDVSRLDLRIGCIITARKHPDADSLYVEEVDVGEIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 37207 - protein, 269 aa, Homo sapiens
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAPRTVVSGLVNHVPLEQMQNRMVILLCNLKPAKMRGVLSQAMVMCASSPEKIEILAPPNGSVPGDRITFDAFPGEPDKELNPKKKIWEQIQPDLHTNDECVATYKGVPFEVKGKGVCRAQTMSNSGIK

SEQ ID NO: 37208 - protein, 312 aa, Homo sapiens; identical to SEQ ID NO: 37205

SEQ ID NO: 37209 - protein, 150 aa, Homo sapiens
MANNDAVLKRLEQKGAEADQIIEYLKQQVSLLKEKAILQATLREEKKLRVENAKLKKEIEELKQELIQAEIQNGVKQIPFPSGTPLHANSMVSENVIQSTAVTTVSSGTKEQIKGGTGDEKKAKEKIEKKGEKKEKKQQSIAGSADSKPI

SEQ ID NO: 37210 - protein, 408 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 37211 - protein, 498 aa, Homo sapiens
MWGCQAPLSRLPASGETPMSQSWLVSPLATRPSFTARCSHSTRHTGWRWCCFMERPLTLTRGSSWAHCSYCHRGATGPWPLTFQLTTRSAMTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 37212 - protein, 373 aa, Homo sapiens
MTSKGPEEEHPSVTLFRQYLRIRTVQPKPDYGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 37213 - protein, 343 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 37214 - protein, 336 aa, Homo sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 37215 - protein, 425 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 37216 - protein, 425 aa, Homo sapiens; identical to SEQ ID NO: 37215

SEQ ID NO: 37217 - protein, 180 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKP

SEQ ID NO: 37218 - protein, 209 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLT

SEQ ID NO: 37219 - protein, 429 aa, Homo sapiens
MNYARFITAASAARNPSPIRTMSEKRADILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 37220 - protein, 425 aa, Homo sapiens; identical to SEQ ID NO: 37215

SEQ ID NO: 37221 - protein, 1098 aa, Homo sapiens
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 37222 - protein, 613 aa, Homo sapiens
MVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 37223 - protein, 857 aa, Homo sapiens
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGLAVLYQWTNLFIPVYLTIRAKNIFWFP

SEQ ID NO: 37224 - protein, 841 aa, Homo sapiens
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGKFLNLRFVELN

SEQ ID NO: 37225 - protein, 998 aa, Homo sapiens
MKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 37226 - protein, 926 aa, Homo sapiens
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGYMKALNGFVKLGLINREALPAFRPEANPLTWKQLLCDLVGISPSSEHDVLKEAVLKKLGGDNTQLEAAEWLGLLGDEQVPQAESILDALSKHLVMKLSYGPEEKDMIVMRDSFGIRHPSGHLEHKTIDLVAYGDINGFSAMAKTVGLPTAMAAKMLLDGEIGAKGLMGPFSKEIYGPILERIKAEGIIYTTQSTIKP

SEQ ID NO: 37227 - protein, 926 aa, Homo sapiens; identical to SEQ ID NO: 37226

SEQ ID NO: 37228 - protein, 313 aa, Homo sapiens
MQPQSVLHSGYFHPLLRAWQTATTTLNASNLIYPIFVTYGVKRLEEMLRPLVEEGLRCVLIFGVPSRVPKDERGSAADSEESPAIEAIHLLRKTFPNLLVACDVCLCPYTSHGHCGLLSENGAFRAEESRQRLAEVALAYAKAGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 37229 - protein, 330 aa, Homo sapiens
MQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKTFPNLLVACDVCLCPYTSHGHCGLLSENGAFRAEESRQRLAEVALAYAKAGCQVVAPSDMMDGRVEAIKEALMAHGLGNRVSVMSYSAKFASCFYGPFRDAAKSSPAFGDRRCYQLPPGARGLALRAVDRDVREGADMLMVKPGMPYLDIVREVKDKHPDLPLAVYHVSGEFAMLWHGAQAGAFDLKAAVLEAMTAFRRAGADIIITYYTPQLLQWLKEE

SEQ ID NO: 37230 - protein, 14 aa, Homo sapiens
MPLCPLAHAMQPQS

SEQ ID NO: 37231 - protein, 120 aa, Homo sapiens
MPLCPLAHAMQPQSVLHSGYFHPLLRAWQTATTTLNASNLIYPIFVTDVPDDIQPITSLPGVARYGVKRLEEMLRPLVEEGLRCVLIFGVPSRVPKDERGSAADSEESPAIEAIHLLRKT

SEQ ID NO: 37232 - protein, 59 aa, Homo sapiens
MPLCPLAHAMQPQSVLHSGYFHPLLRAWQTATTTLNASNLIYPIFVTDVPDDIQPITSL

SEQ ID NO: 37233 - protein, 640 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 37234 - protein, 640 aa, Homo sapiens; identical to SEQ ID NO: 37233

SEQ ID NO: 37235 - protein, 114 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQFRLDTPCLPQARALQANALSWQHR

SEQ ID NO: 37236 - protein, 640 aa, Homo sapiens; identical to SEQ ID NO: 37233

SEQ ID NO: 37237 - protein, 640 aa, Homo sapiens; identical to SEQ ID NO: 37233

SEQ ID NO: 37238 - protein, 587 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 37239 - protein, 550 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 37240 - protein, 574 aa, Homo sapiens
MRGGEVALGWNKKKRLFCEDFRFKMVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 37241 - protein, 222 aa, Homo sapiens
  MOD_RES (1)..(1): Any amino acid
XLSFVRPQCRATDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLA

SEQ ID NO: 37242 - protein, 403 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 37243 - protein, 386 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVELPSGPCF

SEQ ID NO: 37244 - protein, 384 aa, Homo sapiens
  MOD_RES (1)..(1): Any amino acid
XAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVELPSGPCF

SEQ ID NO: 37245 - protein, 359 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 37246 - protein, 347 aa, Homo sapiens
MQRAVSVVARLGFRLQAFPPALCRPLSCAQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 37247 - protein, 306 aa, Homo sapiens
MESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 37248 - protein, 919 aa, Homo sapiens
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 37249 - protein, 627 aa, Homo sapiens
MWLAAAAPSLARRLLFLGPPPPPLLLLVFSRSSRRRLHSLGLADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLFILCVREVSGNCCRA

SEQ ID NO: 37250 - protein, 839 aa, Homo sapiens
MPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFENVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 37251 - protein, 264 aa, Homo sapiens
MCHKNGFPQEGGITAAFLQKRKLRLSKNHRPARAKVTEHVRGTRPGRATAGPAASTRAAGSLFFDRWGNRGPAGCRGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 37252 - protein, 197 aa, Homo sapiens
MMFPQSRHSGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTHQEDDGEKSD

SEQ ID NO: 37253 - protein, 453 aa, Homo sapiens
MGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHSALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 37254 - protein, 653 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 37255 - protein, 597 aa, Homo sapiens
MTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTHTFNDDITDSSESLSLCNLIMEETPDSGLAEEIQRSQNDIGAFTWGPDASTDRVSQEVTSGGFGEDSACPSETEQDIRLSTSLLSSADWPTVAEESEHAPGPAFPGGNEQLPPKPAPEAGVAIAACVEMEQLYDPLDSDMPAMDTAGLFKESHEDMKKSDEEEEKQKMEDSLWAGVEACQKASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 37256 - protein, 695 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 37257 - protein, 196 aa, Homo sapiens
MEETPDSGLAEEIQRSQNDIGAFTWGPDASTDRVSQEVTSGGFGEDSACPSETEQDIRLSTSLLSSADWPTVAEESEHAPGPAFPGGNEQLPPKPAPEAGVAIAACVEMEQLYDPLDSDMPAMDTAGLFKESHEDMKKSDEEEEKQKMEDSLWAGVEACQKASGGSFNGFTQPQDTSLFTMQTDQSMICNLEITVN

SEQ ID NO: 37258 - protein, 653 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTAGVEACQKASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 37259 - protein, 385 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPRQYLDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTVGW

SEQ ID NO: 37260 - protein, 252 aa, Homo sapiens
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 37261 - protein, 252 aa, Homo sapiens; identical to SEQ ID NO: 37260

SEQ ID NO: 37262 - protein, 511 aa, Homo sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 37263 - protein, 105 aa, Homo sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVG

SEQ ID NO: 37264 - protein, 226 aa, Homo sapiens
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAIL

SEQ ID NO: 37265 - protein, 511 aa, Homo sapiens; identical to SEQ ID NO: 37262

SEQ ID NO: 37266 - protein, 511 aa, Homo sapiens; identical to SEQ ID NO: 37262

SEQ ID NO: 37267 - protein, 105 aa, Homo sapiens; identical to SEQ ID NO: 37263

SEQ ID NO: 37268 - protein, 226 aa, Homo sapiens; identical to SEQ ID NO: 37264

SEQ ID NO: 37269 - protein, 511 aa, Homo sapiens; identical to SEQ ID NO: 37262

SEQ ID NO: 37270 - protein, 511 aa, Homo sapiens
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVIFRNVVDGQPFTNWYDNGSNQVAFGRGNRGFIVFNNDDWSFSLTLQTGLPAGTYCDVISGDKINGNCTGIKIYVSDDGKAHFSISNSAEDPFIAIHAESKL

SEQ ID NO: 37271 - protein, 511 aa, Homo sapiens
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMSGNAVSAGTSSTCGSYFNPGSRDFPAVPYSGWDFNDGKCKTGSGDIENYNDATQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 37272 - protein, 96 aa, Homo sapiens
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRN

SEQ ID NO: 37273 - protein, 86 aa, Homo sapiens
MKFFLLLFTIGFCWAQYSPNTQQGRTSIVHLFEWRWVDIALECERYLAPKGFGGVQVSPPNENVAIHNPFRPWWERYQPVSYKLCT

SEQ ID NO: 37274 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37275 - protein, 695 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37276 - protein, 639 aa, Homo sapiens
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37277 - protein, 751 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37278 - protein, 752 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37279 - protein, 714 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37280 - protein, 714 aa, Homo sapiens
MLPGLALLLLAAWTARALEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37281 - protein, 746 aa, Homo sapiens
MDQLEDLLVLFINYVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37282 - protein, 660 aa, Homo sapiens
MFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 37283 - protein, 262 aa, Homo sapiens
MRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKARPPPLPGLVATFALQGCGWGH

SEQ ID NO: 37284 - protein, 493 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDSPISAPARDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 37285 - protein, 752 aa, Homo sapiens
TTAMAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 37286 - protein, 737 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKNSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 37287 - protein, 27 aa, Homo sapiens
MAHRKLESVGSGMLDHRVRPGPVPHSQ

SEQ ID NO: 37288 - protein, 749 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 37289 - protein, 737 aa, Homo sapiens; identical to SEQ ID NO: 37286

SEQ ID NO: 37290 - protein, 264 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEA

SEQ ID NO: 37291 - protein, 749 aa, Homo sapiens; identical to SEQ ID NO: 37288

SEQ ID NO: 37292 - protein, 70 aa, Homo sapiens
MAHRKLESVGSGMLDHRVRPGPVPHSQEPESEDMELPLEGYVPEGLELAALRPESPAPEEQECHNHSPDG

SEQ ID NO: 37293 - protein, 4 aa, Homo sapiens
MAHR

SEQ ID NO: 37294 - protein, 112 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLE

SEQ ID NO: 37295 - protein, 749 aa, Homo sapiens; identical to SEQ ID NO: 37288

SEQ ID NO: 37296 - protein, 708 aa, Homo sapiens
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 37297 - protein, 708 aa, Homo sapiens; identical to SEQ ID NO: 37296

SEQ ID NO: 37298 - protein, 710 aa, Homo sapiens [sequence omitted]

SEQ ID NO: 37299 - protein, 451 aa, Homo sapiens [sequence omitted]

SEQ ID NO: 37300 - protein, 559 aa, Homo sapiens
MSVPSSLSQSAINANSHGGPALSLPLPLHAAHNQLLNAKLQATAVGPKDLHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGSNRDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 37301 - protein, 475 aa, Homo sapiens [sequence omitted]

SEQ ID NO: 37302 - protein, 758 aa, Homo sapiens
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37303 - protein, 757 aa, Homo sapiens
SHCIPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37304 - protein, 210 aa, Homo sapiens
MAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37305 - protein, 10 aa, Homo sapiens
MSEVLPADSG

SEQ ID NO: 37306 - protein, 210 aa, Homo sapiens; identical to SEQ ID NO: 37304

SEQ ID NO: 37307 - protein, 737 aa, Homo sapiens
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37308 - protein, 759 aa, Homo sapiens
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETADIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37309 - protein, 27 aa, Homo sapiens
MSEVLPADSGVDTLAVFMASSGTTDVT

SEQ ID NO: 37310 - protein, 68 aa, Homo sapiens
MSEVLPADSGVDTLAVFMASSGTTDVTNRNSPATPPNTLNLRSSHNELLNAEIKHTETKNSTPPKCRK

SEQ ID NO: 37311 - protein, 736 aa, Homo sapiens
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37312 - protein, 728 aa, Homo sapiens
  MOD_RES (1)..(1): Any amino acid
XDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETADIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 37313 - protein, 210 aa, Homo sapiens; identical to SEQ ID NO: 37304

SEQ ID NO: 37314 - protein, 491 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRPISAPARDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 37315 - protein, 486 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDRDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 37316 - protein, 339 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDRDFAFVASDKDSCMLKCHVFCCDVPAKAIASALHGLCAQILSERVEVSGDASCCSPDPISPEDLPRQVELLDAVSQAAQKYEALYMGTLPVTKAMGRGQYRGGAIVAVPCAPCDIYWCWPRPTHLWPHR

SEQ ID NO: 37317 - protein, 484 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRDFAFVASDKDSCMLKCHVFCCDVPAKAIASALHGLCAQILSERVEVSGDASCCSPDPISPEDLPRQVELLDAVSQAAQKYEALYMGTLPVTKAMGMDVLNEAIGTLTARGDRNAWVPTMLSVSDSLMTAHPIQAEASTEEEPLWQCPVRLVTFIGVGRDPHTFGLIADLGRQSFQCAAFWCQPHAGGLSEAVQAACMVQYQKCLVASAARGKAWGAQARARLRLKRTSSMDSPGGPLPLPLLKGGVGGAGATPRKRGVFSFLDAFRLKPSLLHMP

SEQ ID NO: 37318 - protein, 245 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLVHIRVWGVGSSKGRSSDVDPGLLPLPGPALVGEGGPSSAGTVWGESERLG

SEQ ID NO: 37319 - protein, 263 aa, Homo sapiens [sequence omitted]

SEQ ID NO: 37320 - protein, 214 aa, Homo sapiens
MLGKDYMLAIILVNCDDDLWGDHSLEVEAGLPPGWRKIHDAAGTYYWHVPSGSTQWQRPTWELGDAEDPGTGTEGIWGLRPPKGRSFSSLESSLDRSNSLSWYGGESYIQSMEPGAKCFAVRSLGWVEVPEEDLAPGKSSIAVNNCIQQLAQTRSRSQPPDGAWGEGQNMLMILKKDAMSLVNPLDHSLIHCQPLAVIPTDADPQYLNPWTQIL

SEQ ID NO: 37321 - protein, 651 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDADTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 37322 - protein, 611 aa, Homo sapiens
MLASLEKDKTAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 37323 - protein, 763 aa, Homo sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37324 - protein, 761 aa, Homo sapiens
MLRAPGELPRQAARCSLCRLGPGRGRAFFKWRCLPASVDRGNPLWALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37325 - protein, 751 aa, Homo sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37326 - protein, 522 aa, Homo sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37327 - protein, 695 aa, Homo sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37328 - protein, 159 aa, Homo sapiens [sequence omitted]

SEQ ID NO: 37329 - protein, 116 aa, Homo sapiens
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNSGWRCVRITSTGTR

SEQ ID NO: 37330 - protein, 551 aa, Homo sapiens
MEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKVPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37331 - protein, 658 aa, Homo sapiens
MYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 37332 - protein, 585 aa, Homo sapiens
MAAVELEWIPETLYNTAISAVVDNYIRSRRDIRSLPENIQFDVYYKLYQQGRLCQLGSEFCELEVFAKVLRALDKRHLLHHCFQALMDHGVKVASVLAYSFSRRCSYIAESDAAVKEKAIQVGFVLGGFLSDAGWYSDAEKVFLSCLQLCTLHDEMLHWFRAVECCVRLLHVRNGNCKYHLGEETFKLAQTYMDKLSKHGQQANKAALYGELCALLFAKSHYDEAYKWCIEAMKEITAGLPVKVVVDVLRQASKACVVKREFKKAEQLIKHAVYLARDHFGSKHPKYSDTLLDYGFYLLNVDNICQSVAIYQAALDIRQSVFGGKNIHVATAHEDLAYSSYVHQYSSGKFDNALFHAERAIGIITHILPEDHLLLASSKRVKALILEEIAIDCHNKETEQRLLQEAHDLHLSSLQLAKKAFGEFNVQTAKHYGNLGRLYQSMRKFKEAEEMHIKAIQIKEQLLGQEDYEVALSVGHLASLYNYDMNQYENAEKLYLRSIAIGKKLFGEGYSGLEYDYRGLIKLYNSIGNYEKVFEYHNVLSNWNRLRDRQYSVTDALEDVSTSPQSTEEVVQSFLISQNVEGPSC

SEQ ID NO: 37333 - protein, 1657 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 37334 - protein, 139 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSI

SEQ ID NO: 37335 - protein, 106 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAV

SEQ ID NO: 37336 - protein, 585 aa, Homo sapiens
  MOD_RES (1)..(1): Any amino acid
XLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKDNSGLIEQVGKCSLLPYFLKVCEALVLFLL

SEQ ID NO: 37337 - protein, 576 aa, Homo sapiens
MGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKDNSGLIEQVGKCSLLPYFLKVCEALVLFLL

SEQ ID NO: 37338 - protein, 396 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQVPAQFYKIKVCLELNCMGFSLETLK

SEQ ID NO: 37339 - protein, 725 aa, Homo sapiens
MEQSNDSLRVNHNDGEESKTSAQVFEHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKTVDYKKLSAT

SEQ ID NO: 37340 - protein, 725 aa, Homo sapiens; identical to SEQ ID NO: 37339

SEQ ID NO: 37341 - protein, 54 aa, Homo sapiens
MEQSNDSLRVNHNDGEESKTSAQVFEHLICMDSRDSSFGQNDSPTVLPITTREA

SEQ ID NO: 37342 - protein, 131 aa, Homo sapiens
MEQSNDSLRVNHNDGEESKTSAQVFEHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIP

SEQ ID NO: 37343 - protein, 21 aa, Homo sapiens
MEQSNDSLRVNHNDGEESKTS

SEQ ID NO: 37344 - protein, 73 aa, Homo sapiens
MEQSNDSLRVNHNDGEESKTSAQVFEHLICMDSRDSSFGQNDSPTVLPITTREANNSLISQNIPGPLTQTQTL

SEQ ID NO: 37345 - protein, 725 aa, Homo sapiens; identical to SEQ ID NO: 37339

SEQ ID NO: 37346 - protein, 73 aa, Homo sapiens; identical to SEQ ID NO: 37344

SEQ ID NO: 37347 - protein, 95 aa, Homo sapiens
MEQSNDSLRVNHNDGEESKTSAQVFEHLICMDSRDSSFGQNDSPTVLPITTREANNSLISQNIPGPLTQTQTLSAEQFHLVDQNGQAIQYELQSL

SEQ ID NO: 37348 - protein, 207 aa, Homo sapiens
MLEAWNLNLSHYLKHLICMDSRDSSFGQNDSPTVLPITTREANNSLISQNIPGPLTQTQTLSAEQFHLVDQNGQAIQYELQSLGESNAQMMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEGVELW

SEQ ID NO: 37349 - protein, 637 aa, Homo sapiens
MLEAWNLNLSHYLKMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKTVDYKKLSAT

SEQ ID NO: 37350 - protein, 649 aa, Homo sapiens
MEQSNDSLRVNHNDGEESKTSAQVFEMIVASPTENGQVLRVIPPTQTGMAQVIIPQGQLVDVNSPRDVPEEKPSNRNLPTVRVDTLADNTSNYILHPQTSFPLPKKSVTGMLEEPLLGPLQPLSSNTPIWACRLRSCEKIGDSYRGYCVSETELESVLTFHKQQTQSVWGTRQSPSPAKPATRLMWKSQYVPYDGIPFVNAGSRAVVMECQYGPRRKGFQLKKVSEQESRSCQLYKATCPARIYIKKVQKFPEYRVPTDPKIDKKIIRMEQEKAFNMLKKNLVDAGGVLRWYVQLPTQQAHQYHELETPCLTLSPSPFPVSSLEEEETAVRDENCALPSRLHPQVAHKIQELVSQGIEQVYAVRKQLRKFVERELFKPDEVPERHNLSFFPTVNDIKNHIHEVQKSLRNGDTVYNSEIIPATLQWTTDSGNILKETMTVTFAEGNSPGESITTKVETNQTRGSLSPEPTHLLSSLSSFQPKIFTQLQGLQLQPRYTSPDESPAVVSVNNQPSSSPSGLLDTIGSAVMNNNSLLLGQSHSLQRDTCLTQNNSTASTMGNLPEPDQNLVAMDELVEVGDVEDTGNLEGTVHRILLGDVQTIPIQIIDNHSALIEENPESTISVSQVKQEPKEPALSMEAKKTVDYKKLSAT

SEQ ID NO: 37351 - protein, 185 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKIYTPVEESSIGKFPRCTTIDFMMYRSIR

SEQ ID NO: 37352 - protein, 185 aa, Homo sapiens; identical to SEQ ID NO: 37351

SEQ ID NO: 37353 - protein, 68 aa, Homo sapiens
MTTPNKTPPGADPKQLERTGTVREIGSQAVWSLSSCKPGFGVDQLRDDNLETYWQSDGSQPHLVNIQF

SEQ ID NO: 37354 - protein, 109 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIR

SEQ ID NO: 37355 - protein, 185 aa, Homo sapiens; identical to SEQ ID NO: 37351

SEQ ID NO: 37356 - protein, 158 aa, Homo sapiens
MTTPNKTPPGADPKQLERTGTVREIGSQAVWSLSSCKPGFGVDQLRDDNLETYWQSDGSQPHLVNIQFRRKTTVKTLCIYADYKSDESYTPSKISVRVGNNFHNLQEIRQLELVEPSGWIHVPLTDNHKKPTRTFMIQIAVLANHQNGRDTHMRQIKI

SEQ ID NO: 37357 - protein, 158 aa, Homo sapiens; identical to SEQ ID NO: 37356

SEQ ID NO: 37358 - protein, 110 aa, Homo sapiens
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQLLGFTPSSG

SEQ ID NO: 37359 - protein, 808 aa, Homo sapiens
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 37360 - protein, 162 aa, Homo sapiens
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSD

SEQ ID NO: 37361 - protein, 809 aa, Homo sapiens
MLRFPTCFPSFRVVGEKQLPQEIIFLVWSPKRDLIALANTAGEVLLHRLASFHRVWSFPPNENTGKEVTCLAWRPDGKLLAFALADTKKIVLCDVEKPESLHSFSVEAPVSCMHWMEVTVESSVLTSFYNAEDESNLLLPKLPTLPKNYSNTSKIFSEENSDEIIKLLGDVRLNILVLGGSSGFIELYAYGMFKIARVTGIAGTCLALCLSSDLKSLSVVTEVSTNGASEVSYFQLETNLLYSFLPEVTRMARKFTHISALLQYINLSLTCMCEAWEEILMQMDSRLTKFVQEKNTTTSVQDEFMHLLLWGKASAELQTLLMNQLTVKGLKKLGQSIESSYSSIQKLVISHLQSGSESLLYHLSELKGMASWKQKYEPLGLDAAGIEEAITAVGSFILKANELLQVIDSSMKNFKAFFRWLYVAMLRMTEDHVLPELNKVMTQKDITFVAEFLTEHFNEAPDLYNRKGKYFNVERVGQYLKDEDDDLVSPPNTEGNQWYDFLQNSSHLKESPLLFPYYPRKSLHFVKRRMENIIDQCLQKPADVIGKSMNQAICIPLYRDTRSEDSTRRLFKFPFLWNNKTSNLHYLLFTILEDSLYKMCILRRHTDISQSVSNGLIAIKFGSFTYATTEKVRRSIYSCLDAQFYDDETVTVVLKDTVGREGRDRLLVQLPLSLVYNSEDSAEYQFTGTYSTRLDEQCSAIPTRTMHFEKHWRLLESMKAQYVAGNGFRKVSCVLSSNLRHVRVFEMDIDDEWELDESSDEEEEASNKPVKIKEEVLSESEAENQQAGAAALAPEIVIKVEKLDPELDS

SEQ ID NO: 37362 - protein, 755 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 37363 - protein, 643 aa, Homo sapiens
MAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 37364 - protein, 643 aa, Homo sapiens; identical to SEQ ID NO: 37363

SEQ ID NO: 37365 - protein, 219 aa, Homo sapiens
MLSPCLSSYFVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYTSPPWEYSPLFNRELLLGRRQTS

SEQ ID NO: 37366 - protein, 44 aa, Homo sapiens
MAEGELKDMEQFFDDLSDSFSGTEPEVHKTSVVGLFLRHMILAY

SEQ ID NO: 37367 - protein, 357 aa, Homo sapiens
MDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 37368 - protein, 742 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHYLSYLNNLRVQDVFSSTHSLLHYFDRLILTGAESKSNGEEGYGRSLRYAALNLAALHCRFGHYQQAELALQEAIRIAQESNDHVCLQHCLSWLYVLGQKRSDSYVLLEHSVKKAVHFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVISVLLSVAELYWRSSSPTIALPMLLQALALSKEYRLQYLASETVLNLAFAQLILGIPEQALSLLHMAIEPILADGAILDKGRAMFLVAKCQVASAASYDQPKKAEALEAAIENLNEAKNYFAKVDCKERIRDVVYFQARLYHTLGKTQERNRCAMLFRQLHQELPSHGVPLINHL

SEQ ID NO: 37369 - protein, 474 aa, Homo sapiens
MELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTVSESEAESATGRFPGAQLKAPLSPLAFPMEDTELPLTPILYPTCQFFFIFLNIFLLAFSSPGSQPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 37370 - protein, 410 aa, Homo sapiens
MELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 37371 - protein, 375 aa, Homo sapiens
MELPSGPGPERLFDSHRLPGDCFLLLVLLLYAPVGFCLLVLRLFLGIHVFLVSCALPDSVLRRFRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKAFDACLMMMTPQAL

SEQ ID NO: 37372 - protein, 714 aa, Homo sapiens
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQEPASALATEDTSLEGSSLAESLRAAAEAAVSQTGFSYDENTGLYFDHSTGFYYDSENQLYYDPSTGIYYYCDVESGRYQFHSRVDLQPYPTSSTKQSKDKKLKKKRKDPDSSATNEEKDLNSEDQKAFSVEHTSCNEEENFANMKKKAKIGIHHKNSPPKVTVPTSGNTIESPLHENISNSTSFKDEKIMETDSEPEEGEITDSQTEDSYDEAITSEGNVTAEDSEDEDEDKIWPPCIRVIVIRSPVLQIGSLFIITAVNPATIGREKDMEHTLRIPEVGVSKFHAEIYFDHDLQSYVLVDQGSQNGTIVNGKQILQPKTKCDPYVLEHGDEVKIGETVLSFHIHPGSDTCDGCEPGQVRAHLRLDKKDESFVGPTLSKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 37373 - protein, 176 aa, Homo sapiens
MASEAPSPPRSPPPPTSPEPELAQLRRKVEKLERELRSCKRQVREIEKLLHHTERLYQNAESNNQELRTQVEELSKILQRGRNEDNKKSDVEVQTENHAPWSISDYFYQTYYNDVSLPNKVTELSDQQDQAIETSILNSKDHLQVENDAYPGTDRTENVKYRQVDHFASNSQVIKC

SEQ ID NO: 37374 - protein, 675 aa, Homo sapiens
MPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 37375 - protein, 597 aa, Homo sapiens
MEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGNDSK

SEQ ID NO: 37376 - protein, 1084 aa, Homo sapiens
MRNSEEQPSGGTTVLQRLLQEQLRYGNPSENRSLLAIHQQATGNGPPFPSGSGNPGPQSDVLSPQDHHQQLVAHAARQEPQGQEIQSENLIMEKQLSPRMQNNEELPTYEEAKVQSQYFRGQQHASVGAAFYVTGVTNQKMRTEGRPSVQRLNPGKMHQDEGLRDLKQGHVRSLSERLMQMSLATSGVKAHPPVTSAPLSPPQPNDLYKNPTSSSEFYKAQGPLPNQHSLKGMEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 37377 - protein, 852 aa, Homo sapiens
MEHRGPPPEYPFKGMPPQSVVCKPQEPGHFYSEHRLNQPGRTEGQLMRYQHPPEYGAARPAQDISLPLSARNSQPHSPTSSLTSGGSLPLLQSPPSTRLSPARHPLVPNQGDHSAHLPRPQQHFLPNQAHQGDHYRLSQPGLSQQQQQQQQQHHHHHHHQQQQQQQPQQQPGEAYSAMPRAQPSSASYQPVPADPFAIVSRAQQMVEILSDENRNLRQELEGCYEKVARLQKVETEIQRVSEAYENLVKSSSKREALEKAMRNKLEGEIRRMHDFNRDLRERLETANKQLAEKEYEGSEDTRKTISQLFAKNKESQREKEKLEAELATARSTNEDQRRHIEIRDQALSNAQAKVVKLEEELKKKQVYVDKVEKMQQALVQLQAACEKREQLEHRLRTRLERELESLRIQQRQGNCQPTNVSEYNAAALMELLREKEERILALEADMTKWEQKYLEENVMRHFALDAAATVAAQRDTTVISHSPNTSYDTALEARIQKEEEEILMANKRCLDMEGRIKTLHAQIIEKDAMIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMVAAAPVAVAAAAAPAAAAAPSPATAAATAAAVSPAAAGQIPAAASVASAAAVAPSAAAAAAVQVAPAAPAPVPAPALVPVPAPAAAQASAPAQTQAPTSAPAVAPTPAPTPTPAVAQAEVPASPATGPGPHRLSIPSLTCNPDKTDGPVFHSNTLERKTPIQILGQEPDAEMVEYLI

SEQ ID NO: 37378 - protein, 182 aa, Homo sapiens
MIKVLQQRSRKEPSKTEQLSCMRPAKSLMSISNAGSGLLSHSSTLTGSPIMEEKRDDKSWKGSLGILLGGDYRAEYVPSTPSPVPPSTPLLSAHSKTGSRDCSTQTERGTESNKTAAVAPISVPAPVAAAATAAAITATAATITTTMAAAAAPSPATAAATAAAVSPAAAGQIPAAASVASA

SEQ ID NO: 37379 - protein, 1084 aa, Homo sapiens; identical to SEQ ID NO: 37376

SEQ ID NO: 37380 - protein, 503 aa, Homo sapiens
MLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGWWFDACGLSNLNGVYYHAPDNKYKMDGIRWHYFKGPSYSLRASRMMIRPLDI

SEQ ID NO: 37381 - protein, 410 aa, Homo sapiens
MLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRVVV

SEQ ID NO: 37382 - protein, 460 aa, Homo sapiens
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 37383 - protein, 388 aa, Homo sapiens
MMSPSQASLLFLNVCIFICGEAVQGNCVHHSTDSSVVNIVEDGSNAKDESKSNDTVCKEDCEESCDVKTKITREEKHFMCRNLQNSIVSYTRSTKKLLRNMMDEQQASLDYLSNQVNELMNRVLLLTTEVFRKQLDPFPHRPVQSHGLDCTDIKDTIGSVTKTPSGLYIIHPEGSSYPFEVMCDMDYRGGGRTVIQKRIDGIIDFQRLWCDYLDGFGDLLGEFWLGLKKIFYIVNQKNTSFMLYVALESEDDTLAYASYDNFWLEDETRFFKMHLGRYSGNAGDAFRGLKKEDNQNAMPFSTSDVDNDGCRPACLVNGQSVKSCSHLHNKTGWWFNECGLANLNGIHHFSGKLLATGIQWGTWTKNNSPVKIKSVSMKIRRMYNPYFK

SEQ ID NO: 37384 - protein, 470 aa, Homo sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 37385 - protein, 732 aa, Homo sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 37386 - protein, 1306 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 37387 - protein, 691 aa, Homo sapiens
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRTAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 37388 - protein, 511 aa, Homo sapiens
MQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRTAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 37389 - protein, 1145 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFHPFSQHTAA

SEQ ID NO: 37390 - protein, 475 aa, Homo sapiens
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTEPSIRGSVLLLPETKPTLMLELSFMFQM

SEQ ID NO: 37391 - protein, 359 aa, Homo sapiens [sequence omitted]

SEQ ID NO: 37392 - protein, 359 aa, Homo sapiens [sequence omitted]

SEQ ID NO: 37393 - protein, 359 aa, Homo sapiens [sequence omitted]

SEQ ID NO: 37394 - protein, 359 aa, Homo sapiens [sequence omitted]

SEQ ID NO: 37395 - protein, 359 aa, Homo sapiens [sequence omitted]

SEQ ID NO: 37396 - protein, 359 aa, Homo sapiens [sequence omitted]

SEQ ID NO: 37397 - protein, 359 aa, Homo sapiens [sequence omitted]

SEQ ID NO: 37398 - protein, 359 aa, Homo sapiens [sequence omitted]

SEQ ID NO: 37399 - protein, 359 aa, Homo sapiens [sequence omitted]

SEQ ID NO: 37400 - protein, 363 aa, Homo sapiens
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 37401 - protein, 485 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 37402 - protein, 403 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 37403 - protein, 492 aa, Homo sapiens
MVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 37404 - protein, 294 aa, Homo sapiens
MGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 37405 - protein, 156 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 37406 - protein, 1897 aa, Homo sapiens
MAQAAKQLKKIKDIEAQALQEQKEKEESNRKRRNRSRDRKKKADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGTAHITIMGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEDHTSTPNP

SEQ ID NO: 37407 - protein, 1880 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 37408 - protein, 155 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKIIRKVVRQIDLSSADAAQEHEEVELRGSGLQPDLIEGRKGAQIVKRASLKRGKQ

SEQ ID NO: 37409 - protein, 1881 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 37410 - protein, 109 aa, Homo sapiens
MWTFVTQLLVTLVLLSFFLVSCQNVMHIVRGSLCFVLKHIHQELDKELGESEGLSDDEETISTRVVRRRVFLKGNEFQNIPGEQVTEEQFTDEQGNIVTKKDHTSTPNP

SEQ ID NO: 37411 - protein, 1858 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKVELRGSGLQPDLIEGRKGAQIVKRASLKRGKQ

SEQ ID NO: 37412 - protein, 1519 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGISTNNP

SEQ ID NO: 37413 - protein, 1834 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKDHTSTPNP

SEQ ID NO: 37414 - protein, 1905 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKVELRGSGLQPDLIEGRKGAQIVKRASLKRGKQ

SEQ ID NO: 37415 - protein, 1806 aa, Homo sapiens
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQDHTSTPNP

SEQ ID NO: 37416 - protein, 109 aa, Homo sapiens; identical to SEQ ID NO: 37410

SEQ ID NO: 37417 - protein, 3924 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEVQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSAAPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQQESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 37418 - protein, 1863 aa, Homo sapiens
MSHHIQRSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGRASPCLERDNSSFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIGQESRRYPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDSME

SEQ ID NO: 37419 - protein, 3957 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEVQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSAAPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQQESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 37420 - protein, 1872 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 37421 - protein, 995 aa, Homo sapiens
MDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKTETTTEIHPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKELTEELGELEASSDEEAMVTTRVVRRRVIIQGDDMPEIPPETVTEEEYIDEHGHTVVKKVTRKIIRRYVSSEGTEKEEIMVQGMPQEPVNIEEGDGYSKVIKRVVLKSDTEQSEVTLCEPSILSSTSQFQAEPVEGRRVSKVVKTTVVLGERMEKHLGDSSLATDLPSAKDDFEE

SEQ ID NO: 37422 - protein, 1114 aa, Homo sapiens
MTTMLQKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLE

SEQ ID NO: 37423 - protein, 1730 aa, Homo sapiens
MMNEDAAQKSDSGEKFNGSSQRRKRPKKVTCPQMKPEAANIEKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNDETESTETSVLKSHLVNEVPVLASPDLLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQK

SEQ ID NO: 37424 - protein, 1863 aa, Homo sapiens
MTTMLQKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGRASPCLERDNSSFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 37425 - protein, 1861 aa, Homo sapiens
MASSASSSPAGTEDSAPAQGGFGSDYSRSSRKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 37426 - protein, 1868 aa, Homo sapiens
MSEEPKEKNAKPAHRKRKGKKSDANASYLRAARAGHLEKALDYIKNGVDINICNQNGLNALHLASKEGHVEVVSELLQREANVDAATKKGNTALHIASLAGQAEVVKVLVTNGANVNAQSQNGFTPLYMAAQENHLEVVKFLLDNGASQSLATEDGFTPLAVALQQGHDQVVSLLLENDTKGKVRLPALHIAARKDDTKAAALLLQNDNNADVESKSGFTPLHIAAHYGNINVATLLLNRAAAVDFTARNDITPLHVASKRGNANMVKLLLDRGAKIDAKTRDGLTPLHCGARSGHEQVVEMLLDRAAPILSKTKNGLSPLHMATQGDHLNCVQLLLQHNVPVDDVTNDYLTALHVAAHCGHYKVAKVLLDKKANPNAKALNGFTPLHIACKKNRIKVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLSAREGHEDVAAFLLDHGASLSITTKKGFTPLHVAAKYGKLEVANLLLQKSASPDAAGKSGLTPLHVAAHYDNQKVALLLLDQGASPHAAAKNGYTPLHIAAKKNQMDIATTLLEYGADANAVTRQGIASVHLAAQEGHVDMVSLLLGRNANVNLSNKSGLTPLHLAAQEDRVNVAEVLVNQGAHVDAQTKMGYTPLHVGCHYGNIKIVNFLLQHSAKVNAKTKNGYTPLHQAAQQGHTHIINVLLQNNASPNELTVNGNTALGIARRLGYISVVDTLKIVTEETMTTTTVTEKHKMNVPETMNEVLDMSDDEVRKANAPEMLSDGEYISDVEEGNRCTWYKIPKVQEFTVKSEDAMTGDTDKYLGPQDLKELGDDSLPAEGYMGFSLGARSASLRSFSSDRSYTLNRSSYARDSMMIEELLVPSKEQHLTFTREFDSDSLRHYSWAADTLDNVNLVSSPIHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLTELLNGMDEELDSPEELGKKRICRIITKDFPQYFAVVSRIKQESNQIGPEGGILSSTTVPLVQASFPEGALTKRIRVGLQAQPVPDEIVKKILGNKATFSPIVTVEPRRRKFHKPITMTIPVPPPSGEGVSNGYKGDTTPNLRLLCSITGGTSPAQWEDITGTTPLTFIKDCVSFTTNVSARFWLADCHQVLETVGLATQLYRELICVPYMAKFVVFAKMNDPVESSLRCFCMTDDKVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKIEKTDRRQSFASLALRKRYSYLTEPGMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS
